(12) United States Patent
Lough et al.

(10) Patent No.: US 7,071,380 B1
(45) Date of Patent: Jul. 4, 2006

(54) CONTROL OF FLORAL INDUCTION

(75) Inventors: Tony James Lough, Auckland (NZ); Dieter H. Hermsmeier, Doerentrup (DE); Erika Varkonyi-Gasic, Auckland (NZ); Justin Sweetman, Auckland (NZ); Ilkka J. Havukkala, Auckland (NZ); Helene Belanger, Auckland (NZ); Richard L. S. Forster, Auckland (NZ); Keith R. Hudson, Auckland (NZ)

(73) Assignee: Agrigenesis Biosciences Limited, Auckland (NZ)

( * ) Notice: Subject to any disclaimer, the term of this patent is extended or adjusted under 35 U.S.C. 154(b) by 0 days.

(21) Appl. No.: 10/931,081

(22) Filed: Aug. 30, 2004

Related U.S. Application Data

(60) Provisional application No. 60/587,881, filed on Jul. 14, 2004, provisional application No. 60/509,440, filed on Oct. 7, 2003, provisional application No. 60/498,940, filed on Aug. 29, 2003.

(51) Int. Cl.
*C12N 15/29* (2006.01)
*C12N 15/11* (2006.01)
*C12N 15/82* (2006.01)

(52) U.S. Cl. .................. 800/290; 536/23.6; 435/320.1; 435/468

(58) Field of Classification Search ............... 536/23.6, 536/23.1; 435/320.1; 800/278, 287
See application file for complete search history.

(56) References Cited

OTHER PUBLICATIONS

Kardailsky I, Shukla VP, Ahn JH, Dagenais N, Christensen SK, Nguyen JT, Chory J, Harrison MJ, and Weigel D. Activation Tagging of the Floral Inducer FT. (1999) Science vol. 286, pp. 1962-1965.*

* cited by examiner

*Primary Examiner*—Ashwin D. Mehta
*Assistant Examiner*—Cathy Kingdon Worley
(74) *Attorney, Agent, or Firm*—Janet Sleath; Ann W. Speckman; Speckman Law Group PLLC

(57) ABSTRACT

The present application discloses plant polynucleotides, their encoded polypeptide sequences, and sRNA sequences which are putative regulators of long-distance florigenic signaling and flowering control. Methods of using these sequences related to long-distance florigenic signalling, including modifying the occurrence, timing and extent of flower development by modulating the florigenic signaling pathway, are also disclosed.

8 Claims, 41 Drawing Sheets

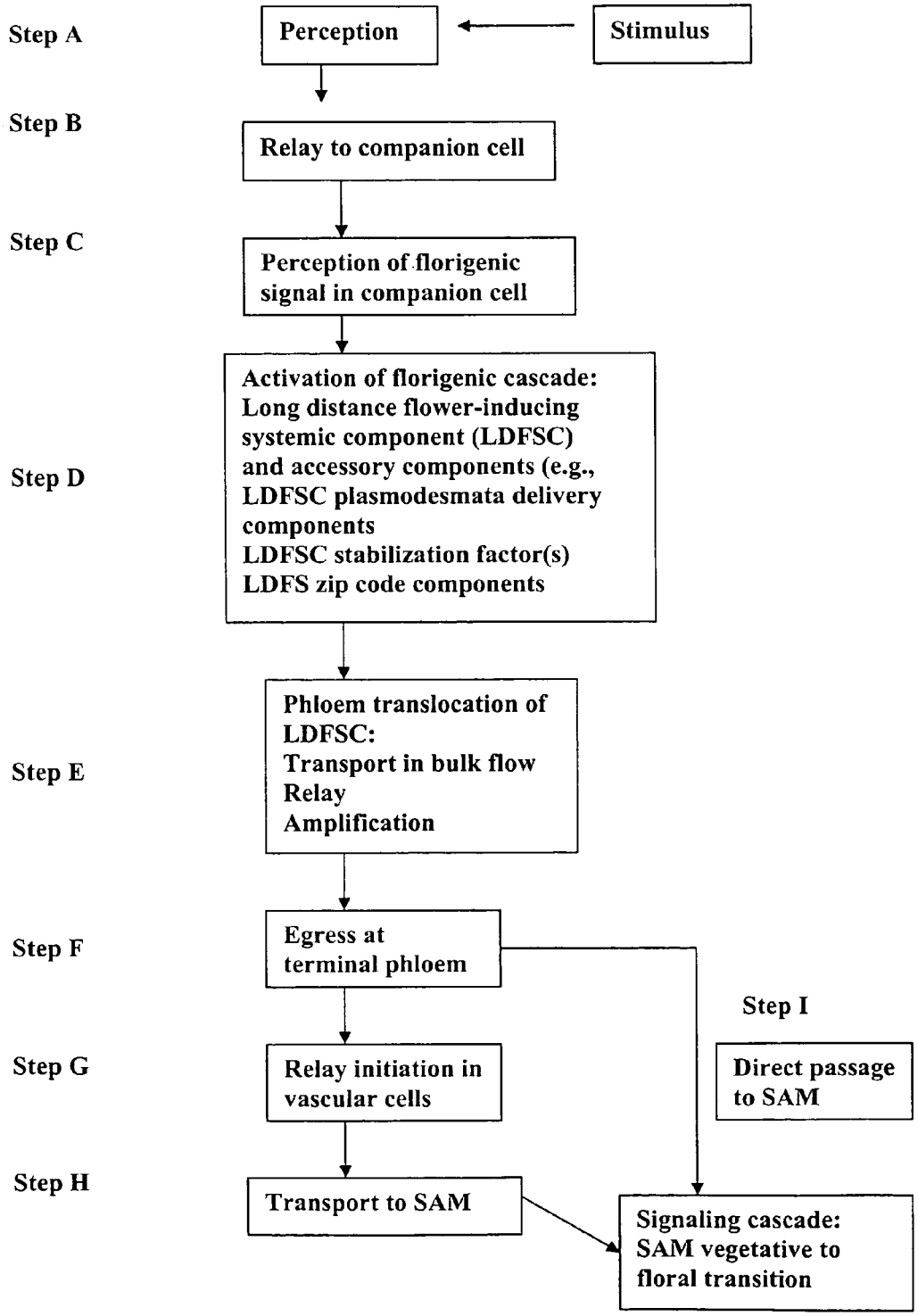

Figure 2.

MDPNSSGEDLVFKTRKPYTITKQRERWTEEEHNRFLEALKLYGRAWQRIEEHIGTKTAVQIRSHAQKFF
SKLEKEALVKGIPVGQTLDIDIPPPRPKRKPSNPYPRKTPISKLGANDGKVLTLVSSSQRKQILDLEKE
PLNEGTSGEEQATIEKDAHDDNYSEVFTLSREANSISWKNTNCVPSQVKLNDSCAFREFVPSLKEPLQD
KGPGKVLEMEISSTSQEKSMPAEKKEALSCVLSGDEMQAAHNYPRHVPVHVVDGSLGANVQGSVTDTLL
QESTFHPAMEVRGEHNIIGNPSDCVSFEHQNNAPRCVYQSYPTIHPTPFTLLRPNQEHYKSLLHMSSSF
SNLVVSTLQQNPAAHAIASLTATCWPYVNPETSVDSPVCDKEGSGTKQMNPTPSMEAIAAATVAAATAW
WAAHGLLPLCAPFHSAFPSAGVSAPVVQSSDTCQNLESKDKAESSQQIVALQNQQLDAEQSEALTAQHS
GSKLPTHSSSDS

Figure 3.

MIDEFQLQDQLSFLNDGSPTIGVKNADLFFPPADLSSSPTGGGFGSYGGDATWGGGPVHRRSCSVNDAC
LGTEDLNCGLGWKP[C]LYFARGF[C]KNGTS[C]RFL[H]GGLGDSDVSAAAVGSPSKIDVMEQCHELLRSKSSA
QQRLAAASQLMASANSFPYSPKSINFLLQQQQNDSQRAAAAAAAAAAALMMGEDLHKFSRSSRLERNEF
SLNGSAGIINPASR*QIYLTFPADSTFKEEDVSNYFSMYGPVQDVRIPYQQKRMFGFVTFVYPETVKLIL*
*AKGNPHFVCDARVLVK*PYKEKGKVPDKKQQQIDRDFSPCGTPTGLDSRELYDHLQLGSRMFYNSHQDLL
WRRKLEEQQADLQTLDLQSRRLLNLQLLDVKKNQLPHHHHRALSTGSPIPSPTHS

Figure 4.

MVCTASDLHGWKDFPKGLRVLLLDGDSNSAAEIKTKLEEMEYVVVTYCNENDALLAISSEPETFHVAIV
EVMASDHDGAFKFLEAVKDLPTILISNIHCLSTMMKCIALGAIEFLQKPVSKDKLRNIWQHVVHKAFNA
GGSAVPSSLKPIKESVASILHLELENDENKNQVPHELEISSGDNVDDHELLLLPEGSDKYPAPSTPQQK
HGMRLVDQMNCLLEKECGEQDREESKSVETTCTAQVENSQLSDKEVIKEEENSTDGCGAASNVDHELHD
RDNISSSEKNKSKACGLGNPCRMKVDWTAELHRKFVQAVEQLGVNQAIPSRILELMKVEGLTRHNVASH
LQKYRMHKRHVLPKEEDGSWSSSKDPMRKNYYPHLQRPVMAYPSPYHSNHVMPVAPIGSWGHMACPSPG
VQMWAPPSYP

Figure 5.

SSGGGYSPYYLQEALAMLKRYLPSNEAEMDSDIDVSGKEIDSPLDAYSSDQFRMYEFKIKKCTRGRSHD
WTECPFAHPGEKARRRDPRRYYSGTA[C]ADFRKGS[C]VKGDA[C]EFA[H]GVFECWLHPARYRTQP[C]KDGTS
[C]RRRV[C]FFA[H]TPEQLRVLPQQSPRSTSSIPSYDGSPLRQAIEACAKQMPYLSSPGTSPPVSPRIESPP
QSPIIKSLNRPHAPSSIKEMVASLRNLQLNKELCKLPSPSSSSSWNVQVGSPVFGSPKESTTRSGLST
LPETSTPPR

Figure 6.

GIHRKPTEVSSQKERADGVKFRAKTEVKESSRRTQRSSSMYKGVRRRKWGKYAAEIRDPFRGRRLWLGT
YNTAEEAAVAYQRKKHEFESMQSMENYSSELSGGKFEEKKIKSLVDDTAESEEIIAMFSHPSPSSVLDL
CTGSLSSNGLKNVIEEFKVDQTREHTITKKSKPVQDGLSST

Figure 7.

MAVLTLSSLPLGFRFRPTDEELINFYLRSKINGNHEEVSVIREIDVCKWEPWDLPDLSIIKTKDPEWFF
FCPQDRKYPNGHRLKRATDAGYWKATGKDRKIKSGTNLIGMKKTLVFYKGRAPKGKRTNWVVHEYRATL
KELDGTNPGQSAFALCRLFKKQDESIEGSNGDEAEAAISSPTTADSSPGPGDSHSEPILPLVSPSLPGR
AESSDEVASETVEHPDGSAEISCFDSYNAEVRGSLFLFIFITRNSA

Figure 8.

DNNGSLALGMFMGNQITENKNMVSNQNQNPVFLGTGVVRSSQPQQQQQPLFPKPANVTFASSMNLVNNP
QLTNGSGTNLVVAPKPPLHDALIQGTGIGAIGLGTRGVTVASRSPTSTISSDVITKSSIEASSFSPVPF
SFGRGRRSSGALEKVVERRQ̄RRMIKNRESAARSRAR̄KQAYTLELEAEVAKLKEMNQELQKKQREIMETQ
KNQVLEKMKYQLGG

Figure 9.

MCSGSKNKVAFSNSAMETKFQKLRDGALFSANSILLELSASDDVDGFKREVEEKDLDVDEPSCWYGRGI
GSKKMG*EERTPLMIAAMYGSSKVVKYLIETGKVDINR*ACGSDMTTALHCASAGGSGSSLETIKLLLDG
SADVDCVDANGRKPVDLIVSACRMVCYSGRKAMEMLLRGDGMAGVGDLSLFLEEDHQKISASLSAKEGS
DKKEYPVDISLPDINSGIYGTDDFRMYTFKVKPCSRAYSHDWTECPFVHPGENARRRDPKKY<u>PYSCVP</u>C̄
<u>PEFRKGA</u>C̄<u>PKGDS</u>C̄<u>EYA</u>H̄<u>GVFESWLHPAQYRTRLCKDETGCTRKVCFFAHRPDELRPVYASTGSGMPS</u>
PRSLSSSAADMSTMSPLALGSSSLSLPTASTPPMSPLASVSSPKNGNLWQNKINLTPPALQLPSSRLKA
TLSARDLDLEMELLGLEKNVSQMQHQQQLIDEISRLSAPSYWSADISRSAELKPSNLDDMFGSLDSSLL
SQLQGTSLKTPISAQVQSQTGLQMRQNMNQLRASYPANLSSSPVKKPSSFGFDSSSAVAAAVMNSRSAA
FAKRSQSFIDRAAVTRLPGLTGAANSAATMSSHLSDWNSPNGKLDWGMHSNDLNKLKKSASFGIRNNGM
GTPTFASPVEEPDVSWVNSLVKDVPSDRFGMFGAEKRAYNLKRDINEMLPSWMEQQLYAEQEQTVA

Figure 10.

<u>MVSKEKSTAKKLPPLCNTNNNARELHFRGVRKRPWGRYAAEIRDPGKKSRVWLGTFDTAEEAAYAYDNA</u>
<u>ARQFRGAKAKTNFPLPDELI</u>DVSPRKISQSPSPSSTVESSSSSSQEKTPSPEIVRSYGVARTFPFIQPQ
FLHQVGGGGSARPVLFMDAFVRPEFVAQGYPIRYDSARFAGEIQTKSDSLSVVDCRPAKEILNLDLNLA
PPVDA

Figure 11.

RPDRVSPWEIEPFVAPTSPSIPQSVSVKNKRLRPPLDIPDSDNSTVTTLRHPGSTQSHDDRTQLSGTAA
EMKRFENHAMWNYKQTDVSSIGNSISRTPKEGSWLASPNRSVSQHRLQNLTDDRNSNYVWSTVFSGAPA
AQSTCPAPHPSNPKSSDQVNDLGEKGRKTEVAPSCRLFGIDIIGHSKSPVPPEMAADQPISAPNEITDA
<u>EQNSDQPKASKERKLGLLQVPPKEIQHKQSSSTNSRSRTKVQMQGMAVGRAVDLTMLEGYGQLIDELEK</u>
<u>MFDIKGELHPRDKWEIVFTDDEGDTMLMGDYPWQEFCNMVRRIYIWSSQDVKMMSSVSKLTMSAMECDG</u>
<u>TVITSKSADS</u>

Figure 12.

<u>MVNMLETDLCLGLPGGGGGEPETPKGNGKRGFSETVDLKLNIQSKPVVTVDLSTTQNMKSTDSEDISSK</u>
<u>DPAKPPAKAQVVGWPPVRSYRKNAMSQKNPDGGEKGSGSAMFVKVCMDGAPYLRKVDLKTYKSYQELSN</u>
<u>ALAKMFSSFTMAGEYGAQGMIDFMNESKLMDLLNSSEYVPTYEDKDGDWMLVGDVPWEMFVDSCRRLRI</u>
<u>MKGSEAIGLAPRAMEKCKSRS</u>

Figure 13.

RSDVHMPDMDGFKLLEQVGLEMDLPVIMMSADDGKNVVMKGVIHGACDYLIKPVRIEALRNIWQHVVRK
RKSEWKDLEQSGSMDDGDRDQNLSEGANYSSSAYDGSWNSSKRKRDAEEELEERDDTSTLKKPRVVWSV
ELHQQFVIAVDQLGIDKAVPKKILELMNVPGLSRENVASHLQKYRLYLRRLSGVSPHPSNLNNAFMNPQ
DHPPFGSMASYNGIDLQTLLVTGQLSPQSLAALQATGLRRPTAKSSLPMALVDQTNIFSFENPKLRFGE
DQTQHLNKTKPASLFHGIPTKMEPKQLANMQHPSVQTQRNMNMPLNIKSEHGGTQLMHLSQQQTVGQTL
NNSTVSHLPGIPSTLRNPIISGSVTTGNGTADNSHGPRYNLVSPTSVMVNYPMSQTTEVFQEEMNSNLK
VSSGVMSSYDVFSDLHMQKAHDWDYQNVSTLAFGTPHHGNFIHHRF

Figure 14.

MDEMKVKPEESVAVGTAVCSSSSSSGSSVTPQPIEGIHDVGPPPFLTKTFEMVEDPLTDSIVSWSKARN
SFIVWDYHKFSSSLLPRYFKHSNFSSFVRQLNTYGFRKVDPDRWEFANEGFLGGQRHLLRTIKRRRHSP
QSFQHHQGGICVELGEFGLEGELERLKRDRSSLMAELVRLRQQHQSSREQIIAMEDRLEKSENKQKQIM
TFLSKALKNPSFVQKFIHSNQGRELRGVEIGRKRRLTSGSSVENLQEESVPAAVKQEEPDMETLLAVNF
EGESNGEITDPVSDGILMAAMDVGHSAPEELGFFSQLWAEDPWAGYPEEEPIIVSNQSDIDVEVEDLIA
EPPDWPENLQELVDQMEFLRPKP

Figure 15.

DNWRKYGQKQVKGSEYPRSYYKCTHPNCQVKKKVERSHEGHITEIIYKGTHTHVKPSPNRRASDSHINM
QLDIPVQAGQQNAEVPLWEDSQKGTPDWMHSNLEVSSSASLGPEYGNHIETAEAIDASSTFSNDEDEDD
RGTHGSITMGYEGEGDESESKKRKLDAYVTEMSGATRAIREPRVVVQTTSEVDILDDGYRWRK

Figure 16.

KLAELWSSDPKRAKRILANRQSAARSKERKARYIQELERKVQTLQTEATTLSAQLTLFQRDTTGLSTE
NTELKLRLQAMEQQAQMRDALNEALKKEVERLKIATGEMMSPSESFNLGMHHMAYAPSSFIQLSQQPGS
 AGPQNIQMPPYNHSPSNMSSHPLHPSDSHSLSEVLQSDPLGRLQGLDISSKGSSLVKSEDPSLSAS

Figure 17.

VNATNSSAVIDSYHNTSSGAPKTVDDVWREIVSGERKELKEEVTDELITLEDFLVKTGAAPVEDVKLPQ
TERLSGGIFSFDSIPGSSFQAVEKVEGSIVGFGSGVDLVGSGGSVGRGKRGRAALEPLDKAAEQRQRRM
IKNRESAARSRERKQAYQVELESLVAKLEEENERILREKAERSKERHKQLMERVIPVVEKRRPPRGIR
RVNSMKW

Figure 18.

VWYGVPGNGAGKLEEAMRKHLPDLFDEQPDLLHKLVTQLSPSILKSEGVPVYRCIQNPGEFVLTFPRAY
HSGFNSGFNCAEAVNVAPVDWLPHGQIAVELYREQGRRTTISHDKLLLGAAREAVRAHWELNLQKRNTL
DNLRWNNVCGKDGVLARAFKTRVELECARRNIPCGSSRAMKMESNFDASNERECSSCLFDLHLSAVGCR
CSPDKYVCLNHANQLS

Figure 19.

FRRQDVPLLQQYLNNHFREFRHIHAGPVPQVFHPVHDQSFYLTLEHKRKLKEEYGIEPWTFVQNLGDAV
FIPAGCPHQVRNLKSCIKVAMDFVSPENVGECIHLTEEFRRLPSNHWAKEDKLEVKKMSVHAMKATIAC
LKEKCK

Figure 20.

ADLQLPPGFRFHPTDDELVTHYLCRKCASQPISVPIIAEIDLYKYNPWDLPERALYGEKEWYFFSPRDR
KYPNGSRPNRSAGSGYWKATGADKPIGRPKAVGIKKALVFYSGKAPKGEKTNWIMHEYRLADVDRSARK
KNSLRLDDWVLCRIYNKKGAIEKQNPPEMNTIGFFENEEQEEKPEILNDRAISGRIPSASPLQGPPSSG
VVNDYVYFDPSDSIPR

Figure 21.

SHPQRKNTSNLTYTTLYIYIIHTRTYTVMDFSDASSSHRSTLSDDELLLASRYPKKRAGRKKFKETRH
PIYRGVRLRNSGKWVCEVREPNKKTRIWLGTFPTAEMAARAHDVAAIALRGRSACLNFADSASTLHIPA
SVDPKDIQRAAAEAAEAFRPQDDELTPAVVDXEGFYLERKWSLGCPGC

Figure 22.

LANCLILLAQGRTGDCASVLVQHNQSLFAYQCKTCDRCFPSFQALGGHRASHKKPKISNSLQTHDPQF
HLSLQLSTGRPPASFAAGDVVKSKVHECSICGAEFSSGQALGGHMRRHRALTSTASVASRGATATPQLQ
ELMIKKERNVLELDLNLPAPEDDRHRTAVAVFSAASSLVDCHY

Figure 23.

MAPVGLPPGFRFHPTDEELVNYYLKRKISGQVIELDIIPEVDLYKCEPWELSEKSFLPSRDPEWYFFGP
RDRKYPNGFRTNRATRAGYWKSTGKDRRVTSHQRAIGMKKTLVYYRGRAPQGIRTDWVMHEYRLDDKDC
EDSSGIQDSYALCRVFKKNGICSEVEEQLSGQSSSSSLSFIDNSNSTSQTLVNDYETLSPDVLMPSPSS
SCVEEEERTIHGCSSL

Figure 24.

MENYQMFFPCSNGGGLSAYSQLDISSGTASDMFRNFHGGDPQASGVLGLKTEVVTAAVEADRNCGGSAN
KKGEKKVRKPRYAFQTRSQVDILDDGYRWRKYGQKAVKNNKFPRSYYRCTHQGCNVKKQVQRLTKDEGV
VVTTYEGMHTHSIDKPTDNFEQILSRMQIYSTPF

Figure 25.

MDTNTSGEELLAKARKPYTITKQRERWTEDEHERFLEALRLYGRAWQRIEEHIGTKTAVQIRSHAQKFF
TKLEKEAEVKGIPVCQALDIEIPPPRPKRKPNTPYPRKPGNNGTSSSQVSSAKDAKLVSSASSSQLNQA
FLDLEKMPFSEKTSTGKENQDENCSGVSTVNKYPLPTKQVSGDIETSKTSTVDNAVQDVPKKNKDKDGN
DGTTVHSMQNYPWHFHADIVNGNIAKCPQNHPSGMVSQDFMFHPMREETHGHANLQATTASATTTASHQ
AFPACHSQDDYRSFLQISSTFSNLIMSTLLQNPAAHAAATFAASVWPYASVGNSGDSSTPMSSSPPSIT
AIAAATVAAATAWWASHGLLPVCAPAPITCVPFSTVAVPTPAMTEMDTVENTQPFEKQNTALQDQNLAS
KSPASSSDDSDETGVTKLNADSKTNDDKIEEVVVTAAVHDSNTAQKKNLVDRSSCGSNTPSGSDAETDA
LDKMEKDKEDVKETDENQPDVIELNNRKIKMRDNNSNNNATTDSWKEVSEEGRIAFQALFARERLPQSF
SPPQVAENVNRKQSDTSMPLAPNFKSQDSCAADQEGVVMIGVGTCKSLKTRQTGFKPYKRCSMEVKESQ
VGNINNQSDEKVCKRLRLEGEAST

Figure 26.

MDSGDATSLLLTKIRSLEPDYAPKIIGNSPSSPSSTSPWSFNNCINGNNGNNPHISPKHTPISKPFSSH
QSNGLSATHSGSADAAGGADLLDDQQLNDCLSFLDDSCSKTEDLVDPSIPLDYSVDGDGETHLHRRSFS
CDASFVSGDDGFGGGCKPCVYFSRGLCKNGESCKFIHGGYPDNMDGNGIVADSPRKMENFVRQHEEMM
RLKLAYQQQRLASQILGRAPQLPYEKRMDFLLQQHAQRDGGLPFGDERFWSSSPGRLERMELAMHLGDQ
SNSASRQ*IYLTFPADSTFKDEDVATYFSLFGTVQDVRIPYQQKRMFGFVSFAHPETVKVVLARGNPHFI
CDSRVLV*KPYKEKGKVLDKKQQQLLQQQIERGNYSPCSSPSGIDPREQSDFHLGSKMLYERREMMRRKI
EQADLLRAIELERRRFINLQLPEFKNSVTLNHHRSFSVGSPGYFSSAGNQSPDFQSELNGADALKVTDD
TLELHPYPVVNPMSVNNSYSNGAKEETNKSELLDPDSGSTIELVLPSNLFPSASSTDDHKTDDSAETNA
KVGVSSTNENDHEPPVTTNNLMQ

Figure 27.

MVITANDLSKWENFPKGLKVLLLLNGCDSDGDGSSAAETRSELESMDYIVTTFTDETEALSAVVKNPES
FHIAIVEVNMSAESESFKFLEAAKDVLPTIMISTDHCITTTMKCIALGAVEFLQKPLSPEKLKNIWQHV
VHKAFNDGGSNVSISLKPVKESVVSMLHLETDMTIEEKDPAPSTPQLKQDSRLLDGDCQENINFSMENV
NSSTEKDNMEDHQDIGESKSVDTTNRKLDDDKVVVKEERGDSEKEEEGETGDLISEKTDSVDIHKKEDE
TKPINKSSGIKNVSGNKTSRKKVDWTPELHKKFVQAVEQLGVDQAIPSRILELMKVGTLTRHNVASHLQ
KFRQHRKNILPKDDHNHRWIQSRENHRPNQRNYNVFQQQHRPVMAYPVWGLPGVYPPGAIPPLWPPPLQ
SIGQPPPWHWKPPYPTVSGNAWGCPVGPPVTGSYITPSNTTAGGFQYPNGAETGFKIMPASQPDEEMLD
QVVKEAISKPWLPLPLGLKPPSAESVLAELTRQGISAVPSSSCLINGSHRLR

Figure 28.

MMIGESHRGFNPTVHIPPWPLSEDLTVSDIYGSPDGGSSMMEALAELQRYLPSNEPDPDSDPDLSGPDS
PIDAYTCDHFRMYEFKVRRCARGRSHDWTECPYAHPGEKARRRDPRKFHYSGTACPEFRKGCCKRGDA
CEFSHGVFECWLHPARYRTQPCKDGGNCRRRVCFFAHSPDQIRVLPNQSPDRVDSFDVLSPTIRRAFQ
FSISPSSNSPPVSPRGDSDSSCSLLSRSLGSNLGNDVVASLRNLQLNKVKSSLSSSYNNQIGGYGSGFG
SPRGSVLGPGFRSLPTTPTRPGFMNIWENGLEEEPAMERVESGRELRAQLFEKLSKENCMGRIEPDPDQ
GAGDTPDVGWVSDLVM

Figure 29.

MCGGAVISDYIAPEKIARSSGKSSWRSNGVFDCSIYDFDGNFDELESDEPFVFSSTHKHHASGSASDGK
KKQSSRYKGIRRRPWGRWAAEIRDPIKGVRVWLGTFNTAEEAARAYDLEAKRIRGAKAKLNFPNESSGK
RKAKAKTVQQVEENHEADLDVAVVSSAPSSSCLDFLWEENNPDTLLIDTQWLEDIIMGDANKKHEPNDS
EEANNVDASLLSEELLAFENQTEYFSQMPFTEGNCDSSTSLSSLFDGGNDMGLWS

Figure 30.

MTTEQALLSMEALPLGFRFRPTDEELINHYLRLKINGRDLEVRVIPEIDVCKWEPWDLPGLSVIKTDDQ
EWFFFCPRDRKYPSGHRSNRATDIGYWKATGKDRTIKSKKMIIGMKKTLVFYRGRAPRGERTNWIMHEY
RATDKELDGTGPGQNPYVLCRLFHKPSDSCDPAHCEEIEKVNFTPTTTTRCSPDDTSSEMVQETATSGV
HALDRSDDTERCLSDKGNNDVKPDVSVINNTSVNHAETSRAKDRNLGKTLVEENPLLRDVPTLHGPILS
EKSYYPGQSSIGFATSHMDSMYSSDFGNCDYGLHFQDGASEQDASLTDVLDEVFHNHNESSNDRKDFVL
PNMMHWPGNTRLLSTEYPFLKDSVAFVDGSAEVSGSQQFVPDILASRWVSEQNVDSKEAVEILSSTGSS
RTLTPLHNNVFGQYASSSYAAIDPFNYNVNQPEQSSFEQSHVDRNISPSNIFEFKARSRENQRDLDSVV
DQGTAPRRIRLQIEQPLTPVTNKKERDADNYEEEDEVQSAMSKVVEEEPANLSAQGTAQRRIRLQTRLR
KPLITLNNTKRNSNGREGEASHRKEKEDISSSSSWQKQKKSLVQFSSVVIIVAVIVVLVEIWKESRDAK
CSFLFHQLDSFKGMFT

Figure 31.

MGSRLNFKSFVDGVSEQQPTVGTSLPLTRQNSVFSLTFDEFQNSWGGGIGKDFGSMNMDELLKNIWTAE
ESHSMMGNNTSYTNISNGNGSGNTVINGGGNNIGGLAVGVGGESGGFFTGGSLQRQGSLTLPRTISQKRV
DDVWKELMKEDDIGNGVVNGGTSGIPQRQQTLGEMTLEEFLVRAGVVREEPQPVESVTNFNGGFYGFGS
NGGLGTASNGFVANQPQDLSGNGVAVRQDLLTAQTQPLQMQQPQMVQQPQMVQQPQQLIQTQERPFPKQ
TTIAFSNTVDVVNRSQPATQCQEVKPSILGIHNHPMNNNLLQAVDFKTGVTVAAVSPGSQMSPDLTPKS
ALDASLSPVPYMFGRVRKTGAVLEKVIERRQKRMIKNRESAARSRARKQAYTMELEAEIAQLKELNEEL
QKKQVEIMEKQKNQLLEPLRQPWGMGCKRQCLRRTLTGPW

Figure 32

MCGAKSNLCSSKTLTEVEFMRQKSEDGASATCLLEFAACDDLSSFKREIEENPSVEIDESGFWYCRRVG
SKKMGFEERTPLMVAAMYGSMEVLNYIIATGRSDVNRVCSDEKVTALHCAVSGCSVSIVEIIKILLDAS
ASPNCVDANGNKPVDLLAKDSRFVPNQSRKAVEVLLTGIHGSVMEEEEEELKSVVTKYPADASLPDINE
GVYGTDDFRMFSFKVKPCSRAYSHDWTECPFVHPGENARRRDPRKYPYTCVPCPEFRKGSCPKGDSCE
YAHGVFESWLHPAQYRTRLCKDETGCARRVCFFAHRRDELRPVNASTGSAMVSPRSSNQSPEMSVMSP
LTLGSSPMNSPMANGVPLSPRNGGLWQNRVNSLTPPPLQLNGSRLKSTLSARDMDMEMELRFRGLDNRR
LGDLKPSNLEETFGSYDSASVMQLQSPSRHSQMNHYPSSPVRQPPPHGFESSAAMAAAVMNARSSAFAK
RSLSFKPAPVASNVSDWGSPNGKLEWGMQRDELNKLRRSASFGIHGNNNNSVSRPARDYSDEPDVSWVN
SLVKENAPERVNERVGNTVNGAASRDKFKLPSWAEQMYIDHEQQIVA

Figure 33.

MAKMGLKPDPATTNQTHNNAKEIRYRGVRKRPWGRYAAEIRDPGKKTRVWLGTFDTAEEAARAYDTAAR
DFRGAKAKTNFPTFLELSDQKVPTGFARSPSQSSTLDCASPPTLVVPSATAGNVPPQLELSLGGGGGGS
CYQIPMSRPVYFLDLMGIGNVGRGQPPPVTSAFRSPVVHVATKMACGAQSDSDSSSVVDFEGGMEKRSQ
LLDLDLNLPPPSEQA

Figure 34.

MANRGGEYLYDELWKLCAGPLVDVPQAQERVYYFPQGHMEQLEASTQQVDLNTMKPLFVLPPKILCNVM
NVSLQAEKDTDEVYAQITLIPVGTEVDEPMSPDPSPPELQRPKVHSFSKVLTASDTSTHGGFSVLRKHA
TECLPPLDMTQQTPTQELVAEDVHGYQWKFKHIFRGQPRRHLLTTGWSTFVTSKRLVAGDTFVFLRGEN
GELRVGVRRANLQQSSMPSSVISSHSMHLGVLATARHATQTKTMFIVYYKPRTSQFIISLNKYLEAMSN
KFSVGMRFKMRFEGEDSPERRYSGTVIGVKDCSPHWKDSKWRCLEVHWDEPASISRPNKVSPWEIEPFV
NSENVPKSVMLKNKRPRQVSEVSALDVGITASNLWSSVLTQPHEFAQSCITSQWSSPQQCHRDANEDAK
KSDWLNNSYSVSNVAKDSTLNDQMVSPVEQKKPETTANYRLFGIDLMSSSLAVPEEKTAPMRPINISKP
TMDSHSDPKSEISKVSEEKKQEPAEGSPKEVQSKQSSSTRSRTKVQMQGVPVGRAVDLNALKGYNELID
DIEKLFDIKGELRSRNQWEIVFTDDEGDMMLVGDDPWPEFCNMVKRIFIWSKEEVKKMTPGNQLRMLLR
EVETTLTTTSKTDNHSN

Figure 35.

MIGQLMNLKATELCLGLPGGAEAVESPAKSAVGSKRGFSETVDLMLNLQSNKEGSVDLKNVSAVPKEKT
TLKDPSKPPAKAQVVGWPPVRNYRKNMMTQQKTSSGAEEASSEKAGNFGGGAAGAGLVKVSMDGAPYLR
KVDLKMYKSYQDLSDALAKMFSSFTMGNYGAQGMIDFMNESKLMNLLNSSEYVPSYEDKDGDWMLVGDV
PWEMFVESCKRLRIMKGSEAVGLAPRAMEKYCKNRS

Figure 36.

MALSLLRKNKHGFDIVISDVHMPDMDGFKLLEHVGLEMDLPVIMMSADDSKSVVLKGVTHGAVDYLIKP
VRMEALKNIWQHVVRKRRSEWVSVPEHSGSIEETGERQQQQHRGGGGGAAVSGGEDAVDDNSSSVNEGNN
WRSSSRKRKDEEGEEQGDDKDEDASNLKKPRVVWSVELHQQFVAAVNQLGVEKAVPKKILELMNVPGLT
RENVASHLQKYRIYLRRLGGVSQHQGNLNNSFMTGQDASFGPLSTLNGFDLQALAVTGQLPAQSLAQLQ
AAGLGRPAMVSKSGLPVSSIVDERSIFSFDNTKTRFGEGLGHHGQQPQQQPQMNLLHGVPTGLQQQLPM
GNRMSIQQQIAAVRAGNSVQNNGMLMPLAGQQSLPRGPPPMLTSSQSSIRQPMLSNRISERSGFSGRNN
IPESSRVLPTSYTNLTTQHSSSSMPYNNFQPELPVNSFPLASAPGISVPVRKATSYQEEVNSSEAGFTT
PSYDMFTTRQNDWDLRNIGIAFDSHQDSESAAFSASEAYSSSSMSRHNTTVAATEHGRNHQQPPSGMVQ
HHQVYADGNGGSVRVKSERVATDTATMAFHEQYSNQEDLMSALLKQEGIAPVDGEFDFDAYSIDNIPV

Figure 37.

MEELKVEMEEETVTFTGSVAASSSVGSSSSPRPMEGLNETGPPPFLTKTYEMVEDPATDTVVSWSNGRN
SFVVWDSHKFSTTLLPRYFKHSNFSSFIRQLNTYGFRKIDPDRWEFANEGFLAGQKHLLKNIKRRRNMG
LQNVNQQGSGMSCVEVGQYGFDGEVERLKRDHGVLVAEVVRLRQQQHSSKSQVAAMEQRLLVTEKRQQQ
MMTFLAKALNNPNFVQQFAVMSKEKKSLFGLDVGRKRRLTSTPSLGTMEENLLHDQEFDRMKDDMEMLF
AAAIDDEANNSMPTKEEQCLEAMNVMMRDGNLEAALDVKVEDLVGSPLDWDSQDLHDMVDQMGFLGSEP

Figure 38.

MAGFDENVAVMGEWVPRSPSPGTLFSSAIGEEKSSKRVLERELSLNHGQVIGLEEDTSSNHNKDSSQSN
VFRGGLSERIAARAGFNAPRLNTENIRTNTDFSIDSNLRSPCLTISSPGLSPATLLESPVFLSNPLAQP
SPTTGKFPFLPGVNGNALSSEKAKDEFFDDIGASFSFHPVSRSSSSFFQGTTEMMSVDYGNYNNRSSSH
QSAEEVKPGSENIESSNLYGIETDNQNGQNKTSDVTTNTSLETVDHQEEEEQRRGDSMAGGAPAEDGY
NWRKYGQKLVKGSEYPRSYYKCTNPNCQVKKVERSREGHITEIIYKGAHNHLKPPPNRRSGMQVDGTE
QVEQQQQQRDSAATWVSCNNTQQQGGSNENNVEEGSTRFEYGNQSGSIQAQTGGQYESGDPVVVVDASS
TFSNDEDEDDRGTHGSVSLGYDGGGGGGGEGDESESKRRKLEAFAAEMSGSTRAIREPRVVVQTTSDV
DILDDGYRWRKYGQKVVKGNPNPRSYYKCTAPGCTVRKHVERASHDLKSVITTYEGKHNHDVPAARNSS
HGGGGDSGNGNSGGSAAVSHHYHNGHHSEPPRGRFDRQVTTNNQSPFSRPFSFQPHLGPPSGFSFGLGQ
TGLVNLSMPGLAYGQGKMPGLPHPYMTQPVGMSEAMMQRGMEPKVEPVSDSGQSVYNQIMSRLPQI

Figure 39.

MEKSDPPPVPKPGATIIPSSDPIPNADPIPSSSFHRRSRSDDMSMFMFMDPLSSAAPPSSDDLPSDDDL
FSSFIDVDSLTSNPNPFQNPSLSSNSVSGAANPPPPPSSRPRHRHSNSVDAGCAMYAGDIMDAKKAMPP
EKLSELWNIDPKRA|KRILANRQSAARSKER|KARYIQELERKVQSLQTEATTLSAQLTLYQRDTNGLANE
NTELKLRLQAMEQQAQLRNALNEALRKEVERMKMETGEISGNSDSFDMGMQQIQYSSSTFMAIPPYHGS
MNLHDMQMHSSFNPMEMSNSQSVSDFLQNGRMQGLEISSNSSSLVKSEGPSLSASESSSAY

Figure 40.

MTSFQVMRSSNSRNSDLSRRISSASTSSSSIRPQQQFRRDLTSVGYGGRNDGLYSSNSMTVEGILHDTF
ASDPPAPTESSLLDASINLMDASPAPMEITTTTASDVVDHGGGTETTRGGKSVDEIWREMVSGEGKGMK
EETSEEIMTLEDFLAKAAVEDETAVTASAEDLDVKIPVTNYGFDHSAPPHNPFQMIDKVEGSIVAFGNG
LDVYGGGARGKRARVMVEPLDKAAAQRQ|RRMIKNRESAARSRER|KQAYQVELEALAAKLEEENELLSKE
IEDKRKERYQKLMEFVIPVVEKPKQQPPRFLRRIRSLEW

Figure 41.

MGTELMRICVKEDSDDLPSVPPGFESYATFTLKRVVPATTSDKAKTPAIESVSATEQAKMEVESDEAKA
ARALRRRPWINHSGCDDDGDCAANNDNAASQNPDQNCDVKPALPKGVVRGCEECKDCQKEFEDTLNYIA
KIRPEAEKYGICRIVPPPSWKPPCPLKEKQVWEGSKFTTRVQRVDKLQNRSSMKKISKLPNQMRKKKRK
CMKMGMDSVTNGMGDPCSASTGMNELETFGFEPGPGFTLKDFQKYADEFKAQYFKKSETSTDDKCKVDN
SIDCWEPALEDVEGEYWRIVDKATEEIEVLYGADLETGVFGSGFPKISSSHNASSSEDKYAKSGWNLNN
FPRLPGSLLKYEGSDISGVLVPWLYIGMCFSSFCWHVEDHHLYSLNYMHWGAPKLWYGVGGKDAVKLEE
AMRKHLPDLFEEQPDLLHKLVTQLSPSKLKTAGVPVHRCVQHAGEFVLTFPRAYHAGFNSGFNCAEAVN
VAPVDWLPHGQIAIELYCQQGRKTSISHDKLLLGAAREVVKADWELNLLRKNTVDNLRWKAFSAKDGIL
AKTLKARIDMERTRREFLCNSSLALKMHSNFDATNERE|CCIC|FFDLHLSAAG|CRC|SPEKYS|CLT|VKE
L|CSC|PWVTKYFLFRYDIDEL|NVLVEAVEGKLSSVYRWARQDLGLALSTDVSGSKMEIDEEGKVHKDPT
PQTTALSGKDLQLKVTSKEVSKELEKTSKLSHVNLLLKEKEEQITSSHCMKPVKEETVCDSSDPNVSAC
QPSEGGIICMTAVKSASGKKNSQSLPNDVILLSDDEYDIPRKRGSVRRDAISSGKKLEIRERPTHVLAL
EASAKIAAPICQREGDSLRDTRNTISLPTNDQKTMRRDVPSSTSHAEVNAEATGLTQDICNRMATNSHG
GGKPTSCKSKNSGGLAIVDVVDGTRSSSGTPSCSQNNSPDRFIRQKGPRIAKVVRRINCNVEPLSY*GCV*
*LSGKSWCSRRAIFPKGFRSRVKYINILDPTNMCFYISEILDA*GRNS*PLFMVYLESNPSEVFVHMSPTRC*
*WEMVRERVNQEITKQHKAGKSDLPPLQPSGSPDGFEMFGYSSPAIVQAIEALDVNRVCTDYWDSRPYSR*
PQVQFPANPLLREANTSGRSNVGNLQLNPGHHISPTGINSILKVLFKKASMEELSSLQEVLSETNSDMV
TELVKEEIQNRR

Figure 42.

MDSGVKLEHMNCFQLSYQYSWTTRKKRTLKPFMSKGSSPSSSSDSRKRKLSRAEDSDDSAVKRNAKRRR
KICKVEEYYEDDDCILSDWVQRNTAKRIDKRNEEVEVMVKIESGDDCTIGKWFSDVSSKRKDKRQVEVD
EDEEWEEEVTLCSKIKATSSRSRTHSLSANSPENVTDVISPCRSRSPASNVSDSIQKNDCTSSRKQSGP
ICHQCLKGERITLLICSECEKTMFCLQCIRKWYPNLSEDDVVEKCPLCRQNCNCSKCLHLNGLIETSKR
ELAKSERRHHLQYLITLMLPFLNKLSIFQKLEIEFEATVQGKLPSEVEITAAISYTDERVYCDHCATSI
VDLHRSCPKCSYELCLKCCQEIREGSLSERPEMKFHYVDRGHRYMHGLDAAEPSLSSTFEDEEANPSDA
KWSLGENGSITCAPEKLGGCGERMLELRRILPLTWMSDLEHKAETFLSSYNISPRMLNCRCSSLETELT
RKSASRTTSSDNYLFCPESLGVLKEEELLHFQEHWAKGEPVIVRNALDNTPGLSWEPMVMWRALCENVN
STSSSEMSQVKAIDCLANCEVEINTRQFFEGYSKGRTYENFWPEMLKLKDWPPSDKFEDLLPRHCDEFI
SALPFQEYSDPRTGILNIATKLPEGFIKPDLGPKTYIAYGIPDELGRGDSVTKLHCDMSDAVNILTHTA
EVTLSQEQISSVKALKQKHKLQNKVDKQSTEDCNEKEEEEEELNMPEISSNENEETGSALWDIFRRED
VPKLEEYLRKHCKEFRHTYCSPVTKVYHPIHDQSCYLTLEHKRKLKAEYGIEPWTFVQKLGEAVFIPAG
CPHQVRNLKSCTKVAVDFVSPENIHECLRLTEEFRQLPKNHKAREDKLEASLLSL

Figure 43.

MSENEIVPDEFRCNRSDGKQWRCKRRALEGKKMCESHHSQQSLKRSKQKVAESSKLVRSRRGGGDEVAS
SEIEPNESRIRSKRLGKSKRKRVMGEAEAMDEAVKKMKLKRGDLQLDLIRMVLKREVEKRKRLPNSNNK
KKSNGGFSEFVGEELTRVLPNGIMAISPPSPTTSNVSSPCDVKVGEEPISMIKRRFRSKNIEPLPIGKM
QDSQSVRSDIDRVLHLHYAVCMLLPVLKEINAEHKVEVENDAEKKVDLQRMCTRSSSVLRLNSDQDQSQ
ESLSRKVGSVKCSNGIKSPKVLLDFHQNNLEHFQTHWSKGHPVIVRSVIKSGSSLNWDPVALFCHYLMN
RNNKTGNTTDCMDWFEVEIGVKQFFLGSLRGKAETNTCQERLKLEGWLSSSLFKEQFPNHYAEILNILP
ISHYMDPKRGLLNIAANLPDTVQPPDFGPCLNISYRSGEEYAQPDSVKKLGFETCDMVDILLYVTETPV
STNQICRIRKLMKNIGRVRSKNPAKGRESRFDKGKKRDRLDDYSSSDSESSQHCLGAKCRGSEFEGEER
ESCNYSCEEESLSNTYGAQWDVFQKQDVSKLLEYIKNHSLELESMDSSKKKVSHPLLEQSYYLDEYHKA
RLKEEFDVEPWSFDQCVGEAVILPAGCPYQIRKNKSCVNAVLKFLSPEHVSESIKRVKELNQLPQSVKS
KANKIEVKKMAIHKISEAVKEIRELTSSDSTGALRLYN

Figure 44.

MSELLQLPPGFRFHPTDEELVMHYLCRKCASQSIAVPIIAEIDLYKYDPWELPGLALYGEKEWYFFSPR
DRKYPNGSRPNRSAGSGYWKATGADKPIGLPKPVGIKKALVFYAGKAPKGEKTNWIMHEYRLADVDRSV
RKKKNSLRLDDWVLCRIYNKKGATERRGPPPPVVYGDEIMEEKPKVTEMVMPPPPQQTSEFAYFDTSDS
VPKLHTTDSSCSEQVVSPEFTSEVQSEPKWKDWSAVSNDNNNTLDFGFNYIDATVDNAFGGGGSSNQMF
RLQDMFMYMQKPY

Figure 45.

MNSFSAFSEMFGSDYESSVSSGGDYIPTLASSCPKKPAGRKKFRETRHPIYRGVRRRNSGKWVCEVREP
NKKTRIWLGTFQTAEMAARAHDVAALALRGRSACLNFADSAWRLRIPESTCAKDIQKAAAEAALAFQDE
MCDATTDHGFDMEETLVEAIYTAEQSENAFYMHDEAMFEMPSLLANMAEGMLLPLPSVQWNHNHEVDGD
DDDVSLWSY

Figure 46.

MGQDEVGSDQTQIIKGKRTKRQRSSSTFVVTAATTVTSTSSSAGGSGGERAVSDEYNSAVSSPVTTDCT
QEEEDMAICLIMLARGTVLPSPDLKNSRKIHQKISSENSSFYVYECKTCNRTFSSFQALGGHRASHKK
PRTSTEEKTRLPLTQPKSSASEEGQNSHFKVSGSALASQASNIINKANKVHECSICGSEFTSGQALGG
HMRRHRTAVTTISPVAATAEVSRNSTEEEIEINIGRSMEQQRKYLPLDLNLPAPEDDLRESKFQGIVF
SATPALIDCHY

Figure 47.

MAPVGLPPGFRFHPTDEELVNYYLKRKINGQEIELDIIPEVDLYKCEPWDLAEKSFLPSRDPEWYFFGP
RDRKYPNGFRTNRATRGGYWKSTGKDRRVTSQSRAIGMKKTLVYYKGRAPQGIRTDWVMHEYRLDDKDC
DDPSSLQDSYALCRVFKKNGICSELESERQLQTGQCSFTTASMEEINSNNNNNYNNDYETMSPEVGVSS
ACVEEVVDDKDDSWMQFITDDAWDTSSNGAAMGHGQGVY

Figure 48.

MEGYDNGSLYAPFLSLKSHSKPELHQGEEESSKVRSEGCSKSVESSKKKGKKQRYAFQTRSQVDILDDG
YRWRKYGQKAVKNNKFPRSYYRCTYGGCNVKKQVQRLTVDQEVVVTTYEGVHSHPIEKSTENFEHILTQ
MQIYSSF

Fig. 51.

MSGRGKGGKGLGKG|GAKRH|RKVLRDNIQGITKPAIRRLARRGGVKRISGLIYEETRGVLKIFLENVIRD
AVTYTEHARRKTVTAMDVVYALKRQGRTLYGFGG

Fig. 52.

KTTPSQETVSNRRSLTRTCVHEVAVPVGYSSTKDESVHGTLPNPVYNGTMAKTYPFTLDPFQQVSVSCL
ERNESILVSAHTSAGKTAVAEYAIAMAFRDKQRVIYTSPLKALSNQKYRELSQEFKDVGLMTGDVTLSP
NASCLVMTTEILRGMLYRGSEVLKEVAWVIFDEIHYMRDRERGVVWEESIIFLPPAIKMVFLSATMSNA
TEFAEWICYIHKQPCHVVYTDFRPTPLQHYVFPAGGNGLYLVVDENEQFREDNFLKLQDTFAKQKQIVG
HRTANGKSSGRIAKGGSASGGSDIYKIVKMIMERNFQPVIVFSFSRRECEQHAMSMSKLDFNTQEEKDM
VEHIFRNAILCLNEEDRELPAIELMLPLLQRGIAVHHSGLLPVIKELVELLFQEGLVKALFATETFAMG
LNMPAKTVVF

Fig. 53.

KRWKFRSATIKNIRLSCCVAGHIKVAEAGEDIQETMDILVDDGLDPMSQEYSYLKYNLLYGGSCSRCGE
WCRLPVIAPCRHLLCLDCVALDSEGCTFPGCGKLYVMQTPETLARPENPNPKWPVPKDLIELQPSYKQD
NWDPDWQSTSSSKVAYLIERLKDLSETNNEAALLPPSSLTKSGALLQEVDHSRAITSDHEIVRDKVLIF
SQFLEHIHVIEQQLTIAGIRFAGMYSPMHASNKMKSLAMFQHDASC

Fig. 54.

RPRIRPWKTTKYVEKVQEGGAGLRENEEISSSPERQSPKGSSKKVRFSEDVEIFPLVDDQNSGKTKEDD
GLIRGKRFSKEEDEIVKKAVFEYIEKHALGDEGLKMVLHCREYPEIKSCWKDIGKAIPYRPYLSVYYRA
HILFERDEKRKWTHEEYELVRKFHDTHGSDWKGLADVLGKHRFHVKDTWRRIKLPNMKKGQWTQDEYQK
LFDLVNKDLRLKAYEEKRSKHGMLRDNICWGAISDVLSTRSTALCCQKWYRQLTSPMVAENEWADVDDY
RLVDALSSLDAYSIEDVEWDQLLEHRDGDVCRKRWSQMVKHIGDNGNKSFSEQVEVLSQRYSIDVLDAR
EAYDNAPVVD

Fig. 55.

LHGLKVSQDEEPVAVSIVSSGGYEDDTNDADVLIYSGQGGVNRKDKESTDQKLERGNLALEKSLHRGNE
VRVVRGVRDFSNPTGKIYVYDGLYKIQESWVEKGKSGCNVFKYKLVRLPGQREAFLTWKLVQQWKDGNA
SRIGVI *IPDLASGAESLPVSLVNDVDDEKGPAYFTYYAGLKYLKPVCSTEPSAGCNCIGGCLPGNLNCP*
*CMQKNGGYLPYSSNGVLASQQSMIYECGASCQ*CPPNCRNR

Fig. 56.

MARTKQTARKSTGGKAPRKQLATKAARKSAPATGGVKKPHRFRPGTVALREIRKYQKSTELLIRKL|PFQ|
|RLVREI|AQDFKTDLRFQSSAVAALQEAAEAYLVGLFEDTNLCAIHAKRVTIMPKDIQLARRIRGERA

Fig. 57.

MANQAESSDSKGTKKDFSTAILERKKALNRLVVDEAINDDNSVVALHPDTMEKLQLFRGDTILIKGKKR
KDTICIALADDTCDEPKIRMNKVVRSNLRVRLGDVVSVHQCADVKYGKRVHILPVDDTIEGVTGNLFDA
YLKPYFLEAYRPLRKGDLFLVRGGMRSVEFKVIETDPAEYCVVAPDTEIFCEGEPVKREDEDRLDEVGY
DDVGGVRKQMAQIRELVELPLRHPQLFKSIGVKPPKGILLYGPPGSGKTLIARAVANETGAFFFCINGP
EIMSKLAGESESNLRKAFEEAEKNAPSIIFIDEIDSIAPKREKTNGEVERRIVSQLLTLMDGLKSRAHV
|IVIGATNRPNSIDPALRR|FGRFDREIDIGVPDEVGRLEVLRIHSKNMKLAEEVDLKRIAKDTHGYVGAD
LAALCTEAALQC

Fig. 58.

MPRNRDPLVVGRVIGDVVDSFSRSISIRVVYDSREVNNGCELKPSQAVNKPRVEIGGTDLRTF FTLVMV
DPDAPSPSDPNLREYLH WLVTDIPATTEATFGQEIVCYENPRPTVGIHRFVLVLFRQLGRQTVYAPGWR
QNFNTRHFAELYNLGSPVAAVYFNCQRENGSGGRRRAGDECS

Fig. 59.

KKDGIVCNAALCKLGCEHKISGFIRDEAFDPQKWAIPGDTHEVHQLTEEVLSNGRKVYVRRKRKVKGKR
IADVVEALIGAYLSTGGERAAIQFLNRIGIEVYFDIVPYERPFSVDAHKLINVRHLEFLLNYTFNDPSL
LLEAMTHGSYMFQEIPRCY QRLEFLGDS VLDYVVTVHLFNKYPGMSPGLLTDMRSASVNNDCYARTAVK
AQLYKSILHLSHDLHKHISSTLKNFEMLS

Fig. 60.

DGLSTLLPDTQANACDIVEDGSFTIDAANYGNIGRFINHSCSPNLYAQNVLYDHEDKRIPHIMFFAAEN
IPPLQELSYHYNYMIDQVRDSDGNVKKKRCHCGSVECTGWMY

Fig. 61.

RFLFPLLTPIRSAIIRRQVYFPDRRLIQFDCGKLQELAILLRKLKSEGHRALIFTQMTKMLDILEAFIN
LYGYTYIRLDGSTQPEERQTLMQRFNTNPKIFLFILSTRSGGVGINLVGADTVIFYDSDWNPAM

Fig. 62.

MAGRGKTLGSGASKKATSRSSKAGLQFPVGRIARFLKAGKYAERVGAGAPVYLAAVLEYLAAEVLELAG
NAARDNKKTRVVPRHIQLAVRNDEELSKLLGDVTIANGGVMPNIHNLLLPKKAGSSKASGGEDES

Fig. 63.

LADYVHRKGLKLGIYSDAGIQTCSKKMPGSLDHEEQDAKTFASWGIDYLKYDNCENTGTSPKERYPKMT
KALQQSGRPILFSLCEWGQEDPATWAVNVGNSWRTTSDMEDNWNSMTTIADQNDKWASYAKPGGWNDPD
MLEVGNGGMTTAEYRSHFSIWALAKAPLLIGCDIRSMDNITLKLLSNKEVIAVNQDKLGVQGKKVYKLG
DLEVWAGTLSGKRVAVVLWNRGFYRAKITASWSAIGLSPSTTVTSRDLWEHSSQVVQHQLTAQVDPHDC
KMYVLTPH

Fig. 64.

HGKVGRWTRAYHLKVPLPPMPPQPARGGPRQRILPTPRGVNMIIWSLDNRFVLAAIMDCRICVWNASDG
SLVHSLTGHTESTYVLDVHPFNPRIAMSAGYDGKTIVWDIWEGTPIRIYEISHFKLVDGKFSSDGTSII
LSDDVGQLYILSTGQGESQQDAKYDQFFLGDYRPLIQDPFGNVVDQETQLSTYRRNLQDLLSDSGMIPY
PEPYQTAYQQRRLGAM

Fig. 65.

CNEKAAFERPMYAEAYCNMGVIYKNRGDLESAIACYERCLAVSPNFEIAKNNMAIALTDLGTKVKLEGN
IAQGVAYYKRALYYNWHYADAMYNLGVAYGEMLKFDMAIVFYELAFHFNPHC

Fig. 66.

IPGVHIGDLFFFRMELCVVGLHGQAQAGIDYVPASQSSNGEPIATSVIVSGGDEDDEDSGDTIIYTGHG
GQDKFSKQCMHQKLEGGNLALERSMHYGIEVRVIRGMKYAGSVTSKIYVYDGLYRILECWFDVGKSGFG
VYKFKLLRIDGQAEMGSSILKFAENLRSKPLSLRPSGYLSLDISMKKEAVPVLLFNDIDNDQEPLYYEY
LVG

Fig. 67.

RCKQAMGFCLHNNAAVSALAAQAAGAKKVLIVDWDVHHGNGTQEIFEQNKSVLYISLHRHEFGRFYPGT
GAADEVGTMGAEGYCVNVPWSRSGVGDNDYIFAFKQVVLPIASAFAPDLTIISAGFDAARGDPLGMCDV
TPTGYNLRSISSSATAVIKVLLGESPECDLDDHLPSSAGMKTVLDVLAIQKNFWPVLESSFSKLQSMLE
IFATERRGKVKPCKQRRRAVVAPI

Fig. 68.

MGRKKIELKRIEDMCNRHVTFCKRRSGLIKKARELSVLCDVEVGLVIFTNRGRLYEFCSGDSLLNIIKR
YQSHFEGRSESQNEVDTKENEESDETLMVSFGKLLQTIQSHVEEPDFKKLNVNDMVHLENQLEASLDKI
KSQRVEAMMENSSWIDKMDMAIAMVDSQL

Fig. 69.

MSGRGKGGKGLGKGGAKRHRKVLRDNIQGITKPAIRRLARRGGVKRISGLIYEETRGVLKIFLENVIRD
AVTYTEHARRKTVTAMDVVYALKRQGRTLYGFGG

Fig. 70.

MSAQMEEPETLGKRKESESSKLRSDETPTPEPRTKRRSLKRACVHEVAVPNDYTPTKEETIHGTLDNPV
FNGDMAKTYPFKLDPFQSVSVACLERKESILVSAHTSAGKTAVAEYAIAMAFRDKQRVIYTSPLKALSN
QKYRELQHEFKDVGLMTGDVTLSPNASCLVMTTEILRAMLYRGSEVLKEVAWVIFDEIHYMKDRERGVV
WEESILFLPPAIKMVFLSATMSNATEFAEWICYLHKQPCHVVYTDFRPTPLQHYAFPMGGGGLYLVVDD
NEQFREDSFVKMQDTFPKPKSNDGKKSANGKSGGRGAKGGGGPGDSDVYKIVKMIMERKFEPVIIFSFS
RRECEQHALSMSKLDFNTDEEKEVVEQVFNNAMQCLNEEDRSL*PAIELMLPLLQRGIAVHHSGLLPVIK
ELVELLFQEGLVKALFATETFAMGLNMPAKTVVFTAVKKWDGDSHRYIGSGEYIQMSGRAGRRGK*DERG
ICIIMIDEQMEMNTLRDMMLGKPAPLLSTFRLSYYTILNLLSRAEGQFTAEHVIRHSFHQFQHEKALPD
IGNKVSKLEEEAAILNASGEAEVAEYHNLQFDIAKHEKKLMSEIIRPERVLCFLDTGRLVKIREGGTDW
GWGVVVNVVKNSSVGTGSASSHGGGYIVDTLLHCSTGFSENGAKPKPCPPRAGEKGEMHVVPVQLPLIS
ALSRLRISVPSDLRPVEARQSILLALQELSSRFPLGFPKLHPVKDMNIQDTEIVDLVSQIEEVEQKLLA
HPMHKSEDDQQIKSFQRKAEVNYEIQQLKSKMRDSQLQKFRDELKNRSRVLKKLGHIDADGVVQVKGRA
ACLIDTGDELLVTELMFNGTFNDLDHHQVAALASCFIPVDKSNEQVNLRNELTKPLQQLQDSARKIAEI
QHECKLEIDVEEYVESTIRPFLMDVIYSWSKGASFAEIIQMTDIFEGSIIRSARRLDEFLNQLRAAAEA
VGESSLESKFAAASESLRRGIMFANSLYL

Fig. 71.

MAQFLRRFSSSPMANEDEFQSPVEPSQQQSQDCVSESYLIGFVIANIVGLKYYSGRINGREMVGLVREP
LNVYDNNAIRVLNTRSEQVGHIERTVAAVLAPMIDSHTIVVEGIVPNTRSNSNRYRIPCQIHVFAKLEA
SSTVKSTISRGGLVLISESDTSFGLSEAVVVKEQMGNGDKRSVDKIFKLVDENVKLMGKLVAAEPPREV
*IKSELFAHQKEGLGWLLHREKSGELPPFWEEKDGEFLNTLTNYRSDKRPDPLRGGVFADDMGLGKTLTL
LSLIAFDRYGNASTSTPTEEPLDGEGDKIEKKGKKRGRGKSSESVTRKKLKTDDVVGMNVSQKTTLIVC
PPSVISAWITQLEEHTVPGILKVYMYHGGERTDDVNELMKYDIVLTTYGTLAVEESWEDSPVKKMEWLR
IILDEAHTIKNANAQQSRVVCKLKASRRWAVTGTPIQNGSFDLYSLMAFLRFEPFSIKSY*WQSLIQRPL
GQGNKKGLSRLQVLMATISLRRTKEKSLIGLPPKTVETCYVELSPEERQLYDHMEGEAKGVVQNLINNG
SLMRNYSTVLSIILRLRQLCDDMSLCPPELRSFTTSTSVEDVTDKPELLQKLVAALQDGEDFD|CPICIS|
|PPTNIIITRCAHIFCRACILQTLQRSKPLCPLCR|GSLTQSDLYNAPPPPPDSSNTDGEDAKSSTKSSKV
SALLSLLMASRQENPNTKSVVFSQFRKML*LLLETPLKAAGFTILRLDGAMTVKKRTQVIGEFGNPELTG
PVVLLASLKASGTGINLTAASRVYLFDPWWNPAVEEQAMDRIHRIGQ*KQEVKMIRMIARNSIEERVLEL
QQKKKNLANEAFKRRQKKDEREVNVEDVVALMSL

Fig. 72.

MQGVPGFNTVPNPNHYDKSIVLDIKPLRSLKPVFPNGNQGPPFVGCPPFGPSSSEYSSFFPFGAQQPTH
DTPDLNQTQNTPIPSFVPPLRSYRTPTKTNGPSSSSGTKRGVGRPKGTTSVKKKEKKTVANEPNLDVQV
VKKFSSDFDSGISAAEREDGNAYLVSSVLMRFDAVRRRLSQVEFTKSATSKAAGTLMSNGVRTN*MKKRV
GTVPGIEVGDIFFSRIEMCLVGLHMQTMAGIDYIISKAGSDEESLATSIVSSGRYEGEAQDPESLIYSG
QGGNADKNRQASDQKLERGNLALENSLRKGNGVRVVRGEEDAASKTGKIYIYDGLYSISESWVEKGKSG
CNTFKYKLVRQPGQPPAFGFWKSVQKWKEGLTTRPGLI*LPDLTSGAESKPVSLVNDVDEDKGPAYFTYT
SSLKYSETFKLTQPVIGCSCSGSCSPGNHNCSCIRKNDGDLPYLNGVILVSRRPVIYECGPTCPCHASC
KNRVIQTGLKSRLEVFKTRNRGWGLRSWDSLRAGSFICEYAGEVKDNGNLRGNQEEDAYVFDTSRVFNS
FKWNYEPELVDEDPSTEVPEEFNLPSPLLISAKKFGNVARFMNHSCSPNVFWQPVIREGNGESVIHIAF
FAMRHIPPMAELTYDYGISPTSEARDESLLHGQRTCLCGSEQCRGSFG

Fig. 73

```
MNVQAHMSGQRSGQVPNQGTVPQNNGNSQMQNLVGSNGAATAVTGAGAATGSGTGVRPSRNIVGAMDHD
IMKLRQYMQTLVFNMLQQRQPSPADAASKAKYMDVARRLEEGLFKMAVTKEDYMNRSTLESRITSLIKG
RQINNYNQRHANSSSVGTMIPTPGLSQTAGNPNLMVTSSVDATIVGNTNITSTALNTGNPLIAGGMHGG
NMSNGYQHSSRNFSLGSGGSMTSMGAQRSTAQMIPTPGFVNSVTNNNSGGFSAEPTIVPQSQQQQQRQH
TGGQNSHMLSNHMAAGVRPDMQSKPSGAANSSVNGDVGANEKIVDSGSSYTNASKKLQQGNFSLLSFCP
DDLISGQHIESTFHISGEGYSTTNPDPFDGAITSAGTGTKAHNINTASFQPVSRVNSSLSHQQQFQQPP
NRFQQQPNQIQQQQQQFLNQRKLKQQTPQQHRLISNDGLGKTQVDSDMVTKVKCEPGMENKSQAPQSQA
SERFQLSQLQNQYQNSGEDCQADAQLLPVESQSDICTSLPQNSQQIQQMMHPQNIGSDSSNSFSNLAVG
VKSESSPQGQWPSKSQENTLMSNAISSGKHIQEDFRQRITGMDEAQPNNLTEGSVIGQNHTSTISESHN
LQNSIGTTCRYGNVSHDPKFKNQQRWLLFLRHARSCKPPGGRCQDQNCVTVQKLWSHMDNCADPQCLYP
RCRHTKALIGHYKNCKDPRCPVCVPVKTYQQQANVRALARLKNESSAVGSVNRSVVSNDSLSANAGAVS
GTPRCADTLDNLQPSLKRLKVEQSFQPVVPKTESCKSSIVSTTEADLSQDAERKDHRPLKSETMEVKVE
IPDNSVQAGFGIKETKSEPFENVPKPKPVSEPGKHGLSGDSPKQENIKMKKEPGWPKKEPGCPKKEELV
ESPELTSKSRKPKIKGVSLTELFTPEQVREHIRGLRQWVGQSKAKAEKNQAMENSMSENSCQLCAVEKI
TFEPPPIYCTPCGARIKRNAMYYTVGGGETRHYFCIPCYNESRGDTILAEGTSMPKAKLEKKKNDEEIE
ESWVQCDKCQAWQHQICALFNGRRNDGGQAEYTCPYCYVIDVEQNERKPLLQSAVLGAKDLPRTILSDH
IEQRLFKRLKQERTERARVQGTSYDEIPTVESLVVRVVSSVDKKLEVKSRFLEIFREDNFPTEFPYKSK
VVLLFQKIEGVEVCLFGMYVQEFGSECSNPNQRRVYLSYLDSVKYFRPDIKSANGEALRTFVYHEILIG
YLEYCKLRGFTSCYIWACPPLKGEDYILYCHPEIQKTPKSDKLREWYLAMLRKAAKEGIVAETTNLYDH
FFLQTGECRAKVTAARLPYFDGDYWPGAAEDIISQMSQEDDGRKGNKKGILKKPITKRALKASGQSDFS
GNASKDLLLMHKLGETIHPMKEDFIMVHLQHSCTHCCTLMVTGNRWVCSQCKDFQLCDGCYEAEQKRED
RERHPVNQKDKHNIFPVEIADIPTDTKDRDEILESEFFDTRQAFLSLCQGNHYQYDTLRRAKHSSMMVL
YHLHNPTAPAFVTTCNVCHLDIESGLGWRCEVCPDYDVCNACYKKEGCINHPHKLTTHPSLADQNAQNK
EARQLRVLQLRKMLDLLVHASQCRSPVCLYPNCRKVKGLFRHGLRCKVRASGGCVLCKKMWYLLQLHAR
ACKESECDVPRCGDLKEHLRRLQQQSDSRRRAAVMEMMRQRAAEVAGTSG
```

Fig. 74.

```
MPSDIMEQRGVSTPSHFHEDIHITSERQFGFMKTDMMPENQGGRDRLSSMPKSSWTSESYQLKPQSSFS
GSHPSGSPNARNTTNGSQWESSLFSSSMSDLFSRKLRLQGSDMLSTMSANTVVTHREEEPSESLEEIEA
QTIGNLLFDEDDLFAEVTGEVGRKSRANTGDELDEFDLFSSVGGMELDGDIFSSVSHRNGERGGNNSVG
ELNRGEIPSRTLLVGNISSNVEDYELKVLFEQFGDIQALHTACKNRGFIMVSYCDIRAAQNAARALQNK
LLRGTKLDIRYSISKENPSQKDTSKGALLVNNLDSSISNQELNRLVKSYGEVKEIRRTMHDNSQIYIEF
FDVRAAAAALGGLNGLEVAGKKLQLVPTYPEGTRYTSQCAANDTEGCLPKTSYSNTSSGHIGRHFPGMI
SSTSSDGGSMRVIHNSIGSPVNSFIERHRSLSIPIGFPPSANGISASKPVGLQEHGHHFDNSNMGIQSM
PNLHPHSFSEYVDNFANGSPYTSSAFSEMVSDGSKANEGFMIHNVRGVEGFSGGGIGSPMHQSSRRPIN
LWSNSNTQQQNPSSGMMWPNSPSHINSIPTQRPPVTVFSRAPPIMVNMASSPVHHHIGSAPVLNSPFWD
RRQAYVAESLESSGFHIGSHGSMGIPGSSPSHPMDIGSHKTFSVGGNRMDVNSQNAVLRSPQQLSHLFP
GRSPMGSMPGSFDSPNERYRNLSHRRSESSSSNADKKLYELDVDRILRGEDRRTTLMIKNIPNKYTSKM
LLSAIDEHCKGTYDFLYLPIDFKNKCNVGYAFINLIEPEKIVPFFKAFNGKKWEKFNSEKVATLTYARI
QGKTALIAHFQNSSLMNEDKRCRPILFHTDGPNAGDQEPFPMGSNIRSRPGKPRSSSIDNYNSFSISSV
SENREETPNGTDPFLKEN
```

Fig. 75.

```
MARTKQTARKSTGGKAPRKQLATKAARKSAPATGGVKKPHRFRPGTVALREIRKYQKSTELLIRKLPFQ
RLVREIAQDFKTDLRFQSSAVAALQEAAEAYLVGLFEDTNLCAIHAKRVTIMPKDIQLARRIRGERA
```

Fig. 76.

MHPKRSSQGDGSVTKPVRTSDRLRRRPKLHGRSYLYYSSPNMLHNRKRNTKTRTAASQIAKMLHKGNRP
ARASNAAPIASDLRRSTRKRRISVNLEDYTDSSGAEDEDMMSPAYRTLRRRVHKNFSTSKSRKDMDAEL
APRREGLRPRRSTTIANKRLKTESGADQDTSEEKDGQDETENGNELDDADDGENEVEAEDEGNGEDEGD
GEDEGEEDGDDDEEGDEEQEGRKRYDLRNRAEVRRMPTGEINKQQQPRSPRRVLHQGMGTRVGRDGRRG
GSRPHKRHRFTRTDDSDDSLLVDELDQGPAIPWARGGNRSGAPWLFGGLDTYGSSSLGLNVGASGWGHQ
SDGLAALTSGVQTAGPSSKGGADIQPLQINEDINFDDIGGLSEYINDLKEMVFFPLLYPEFFASYSITP
PRGVLLCGPPGTGKTLIARALACAASKAGQKVSFYMRKGADVLSKWVGEAERQLKLLFEEAQRNQPSII
FFDEIDGLAPVRSSKQEQIHNSIVSTLLALMDGLDSRGQ|VVLIGATNRVDAIDGALRR|PGRFDREFNFS
LPGCEARAEILDIHTRKWKHPPTRELKEELAATCVGYCGADLKALCTEAAIRAFREKYPQVYTSDDKYA
IDVGLVNVEKSHFVEAMSAITPAAHRGSVVQSRPLSPVVLPCLHRHLLESMSLISDIFPSSATSSELTK
LSILTFGSAIPLVYRPRLLLLGGEGVGLDHLGPAILHELEKFPIHSLGLPSLLSDPGAKTPEEALVHIF
SEARRTTPSILYIPMFNNWWENAHEQLRAVFLTLLEELPSNLPILLLATSYGELSDMEEQSVFDNRSVY
TVDKPSSEDRSLFFDRLIEAALSVISGLNGKPDGPQPLPELPKVPKEPTGPKPAEVKAKVEAEQHALRR
*LRMCLRDVCNRILYDKRFSAFHFPVTDEDAPNYRSIIQIPMDTATLLQRVDTGQYLTCTPFLQDVDLIV*
*RNAKAYNGDDYAGARIVSRAYELRDVVHGMLSQMDP*ALLTYCDKIAAEGGPSLIPDDLSGSILGLAPVV
QMGTVTRTSARLRNVQPEVNLDRDYEGLKKPKKTTDAVSIDSAADKSQNQDSGQEMPSPDAANPQSAAP
SPTDGDREDQSEPPSKEASAEDMSGDSCKGPAAKSDKEISSRTESVKGVFMERTDNYSIPQMERLYTRI
MKGVLETLDKGLRDDDNNPKHSILRFLSEFAQHQANF

Fig. 77.

MKRDHHHHHHQDKKTMMMNEEDDGNGMDELLAVLGYKVRSSEMADVAQKLEQLEVMMSNVQEDDLSQLA
TETVHYNPAELYTWLDSMLTDLNPPSSNAEYDLKAIPGDAILNQFAIDSASSSNQGGGGDTYTTNKRLK
CSNGVVETTTATAESTRHVVLVDSQENGVRLVHALLACAEAVQKENLTVAEALVKQIGFLAVSQIGAMR
KVATYFAEALARRIYRLSPSQSPIDHSLSDTLQMHFYETCPYLKFAHFTANQAILEAFQGKKRVHVIDF
SMSQGLQWPALMQALALRPGGPPVFRLTGIGPPAPDNFDYLHEVGCKLAHLAEAIHVEFEYRGFVANTL
ADLDASMLELRPSEIESVAVNSVFELHKLLGRPGAIDKVLGVVNQIKPEIFTVVEQESNHNSPIFLDRF
TESLHYYSTLFDSLEGVPSGQDKVMSEVYLGKQICNVVACDGPDRVERHETLSQWRNRFGSAGFAAAHI
GSNAFKQASMLLALFNGGEGYRVEESDGCLMLGWHTRPLIATSAWKLSTN

Fig. 78.

MS<u>INIRDPLIVSRVVGDVLDPFNRSITLKVTYGQREVTNGLDLRPSQVQNKPRVEIGGEDLRNF</u>|YTLVM
VDPDVPSPSNPHLREYLH|WLVTDIPATTGTTFGNEIVCYENPSPTAGIHRVVFILFRQLGRQTVYAPGW
RQNFNTREFAEIYNLGLPVAAVFYNCQRESGCGGRRL

Fig. 79.

MADEEEGENSNKLMLVALTATMTKLLDARLEAFRQEHINSDPDRDRTRREPRDPVDDRDTMSYYSQSSR
QTNHRRRRHDREERVLPRDDLAGLKIRIPSFKGTNDPDEYLEWEKKIELVFNCQQYTEESKV<u>KVAPTEF
QNYALSWWDQLVTTRRRAGDYPIESWTQMKTIMRKRFVPSHYYRELHNRLRNLVQGNKSVEEYYKEMET
LMLRADIQEDNEAIMSRFMGGLNRD</u>IIDRLEVQHYVELEELLHKAIMFEKQLKRRSSKPSFGSGKPSYH
KDERSGFQKDYKPFIKPKVEDQDQKGKGKAVMTRTRDIKGFKCQGHGHYASECSNKRIMIIKDTGEIES
EDEQLEESSSTEDYEAPSKGELLVTMKALSVIAKT
DEQEQRENLFHSSCMVNDKVCSLIIDGGSCTNVASETMVEKLGLKVMKHPRPYKLQWLNEDGEMSVDRQ
VKVPLSIGKYEDEILCDILPMEASHILLGRPWQSDRKDYTDVFPEENPVGLPPIRGIEHQIDFVPGASL
PNRPAYRTNPVETKELEKQVTELMERGHIRESMSPCAVPVLLVPKKDGSWRMCVDCRAINNITVKYRHP
IPRLDDMLDELHGSSIFSKVDLKSGYHQIRMKEGDEWKTAFKTIQGLYEWLVMPFGLTNAPSTFMRLMN
HVLRAFIGRFVIVYFDDILVYSKSLEEHVEHLKMVLEVLRKEKLYANLKKCTFGTDNLVFLGFVVSTDG
VKVDEEKVKAIREWPSPKSVGEVRSFHGLAGFYRRFVKDFSTLAAPLTEVIKKNVGFKWEQAQEDAFQA
LKEKLTHAPVLSLPDFLKTFEIECDASGVGIGVVLMQDKKPIAYFSEKLGGATLNYPTYDKELYALVRA
LQTGQHYLWPKEFVIHTDHESLKHLKGQQKLNKRHARWVEFIETFPYVIKYKKGKDNVVADALSRRYVL
LSSLDAKLLGFEHIKSLYANDSDFEKIYSSCEKFAFGKYYRHDGFLFYDNRLCIPNSSLRELFIREAHG
GGLMGHFGVSKTIKVMQDHFHWPHMKRDVERICERCPTCKQAKAKSQPHGLYTPLP*IPSHPWNDISMDF
VVGLPRTRTGKDSIFVVVDRFSKMAHFIPCHKTDDAIHIANLFFREVVRLHGMPKTIVSDRDTKFLSYF
WKTLWSKLGTKLLFSTTCHPQTDGQTEVVNRTLSTLLRALIKKNLKTWEDCLPHVEFAYNHSMHSASKF
SPFQIVYG*FNPTTPLDLMPLPLSERVSLDGKKKAELVQQIHEQAKKNIEEKTKQYAKHANKSRKEVIFN
EGDLVWIHLRKERFPKERKSKLMSRIDGPFKVLKRINNNAYSLDLQGKYNVSNSFNVADLFPFIADNTD
LRSNPFQLGEDDVIMTSLDHGADEIMTSLDHGADEIMTSLDHGDDVIMTSLDHGAKEQFEGGKVINHSI
KHAVEDLRELESNDSMDYSTQHEDELLGATKKEAMHVLNGPMTRSKTRLLNQDITTLLQHIEGSLKQDA
CQTTLVVIQAV

Fig. 80.

MDADAMETETTDQVSAS*PLHFARSYQVEALEKAIKQNTIVFLETGSGKTLIAIMLLRSYAYLFRKPSPC
FCVFLVPQVVLVTQQAEALKMHTDLKVGMYWGDMGVDFWDSSTWKQEVDKYEVLVMTPAILLDALRHSF
LSLSMIKVLIVDECHHAGGKHPYACIMREFYHKELNSGTSNVPRIFGMTASLVYTCENESVLAGFVPFS
TPSFKYYQHIK*IPSPKRASLVEKLERLTIKHRLSLGTLDLNSSTVDSVEKRLLRISSTLTYCLDDLGIL
LAQKAAQSLSASQNDSFLWGELNMFSVALVKKFCSDASQEFLAEIPQGLNWSVANINGNAEAGLLTLKT
VCLIETLLGYSSLENIRCIIFVDRVITAIVLE*SLLAEILPNCNNWKTKYVAGNNSGLQNQTRKKQNEIV
EDFRRGLVNIIVATSILEEGLDVQSCNLVIRFDPASNICSFIQSRGRARMQ*NSDYLMMVERMREESLDH
SLVPCPPLPDDSDEPLFRVESTGATVTLSSSVSLIYHYCSRLPSDEYFKPAPRFDVNKDQGSCTLYLPK
SCPVKEVKAEANNKVLKQAVCLKACIQLHKVGALSDHLVPDMVVAETVSQKLGTRVVLEDDIGNTSFRL
EDHRGTIAVTLSYVGAFHLTQEEVLFCRRFQITLFRVLLDHSVENLMEALNGLHLRDGVALDYLLVPST
HSHETSLIDWEVIRSVNLTSHEVLEKHENCSTNGASRILHTKDGLFCTCVVQNALVYTPHNGYVYCTKG
VLNNLNGNSLLTKRNSGDQTYIEYYEERHGIQLNFVDEPLLNGRHIFTLHSYLHMAKKKKEKEHDREFV
ELPPELCHVILSPISVDMIYSYTFIPSVMQRIESLLIAYNLKKSIPKVNIPT<u>IKVLEAITTKKCEDQFH
LESLETLGDSFLKYAVCQQLFQHCHTHHEGLLSTKKDGMISNVMLCQFGCQQKLQGFIRDECFEPKGWM
VPGQSSAAYSLVNDTLPESRNIYVASRRNLKRKSVADVVESLIGAYLSEGGELAALMFMNWVGIKVDFT
TTKIQRDSPIQAEKLVNVGYMESLLNYSFEDKSLLVEALTHGSYMMPEIPRCY</u>QRLEFLGDSVLDYLIT
KHLYDKYPCLSPGLLTDMRSASVNNECYALVAVKANLHKHILYASHHLHKHISRTVSEFEQSSLQSTFG
WESDISFPKVLGDVIESLAGAIFVDSGYNKEVVFASIKPLLGCMITPETVKLHPVRELTELCQKWQFEL
SKAKDFDSFTVEVKAKEMSFAHTAKASDKKMAKKLAYKEVLNLLKNSLDY

Fig. 81.

MSSLVERLRIRSDRKPVYNLDDSDDDDFVPKKDRTFEQVEAIVRTDAKENACQACGESTNLVSCNTCTY
AFHAKCLVPPLKDASVENWRCPECVSPLNEIDKILDCEMRPTKSSEQGSSDAEPKPIFVKQYLVKWKGL
SYLHCSWVPEKEFQKAYKSNHRLKTRVNNFHRQMESFNNSEDDFVAIRPEWTTVDRILACREEDGELEY
LVKYKELSYDECYWESESDISTFQNEIQRFKDVNSRTRRSKDVDHKRNPRDFQQFDHTPEFLKGLLHPY
QLEGLNFLRFSWSKQTHVILADEMGLGKTIQSIALLASLFEENLIPHLVIAPLSTLRNWEREFATWAPQ
MNVVMYFGTAQARAVIREHEFYLSKDQKKIKKKKSGQISSESKQKRIKFDVLLTSYEMINLDSAVLKPI
KWECMIVDEGHRLKNKDSKLFSSLTQYSSNHRILLTGTPLQNNLDELFMLMHFLDAGKFGSLEEFQEEF
KDINQEEQISRLHKMLAPHLLRRVKKDVMKDMPPKKELILRVDLSSLQKEYYKAIFTRNYQVLTKKGGA
QISLNNIMMELRKVCCHPYMLEGVEPVIHDANEAFKQLLESCGKLQLLDKMMVKLKEQGHRVLIYTQFQ
HMLDLLEDYCTHKKWQYERIDGKVGGAERQIRIDRFNAKNSNKFCFLLSTRAGGLGINLATADTVIIYD
SDWNPHADLQAMARAHRLGQTNKVMIYRLINRGTIEERMMQLTKKKMVLEHLVVGKLKTQNINQEELDD
IIRYGSKELFASEDDEAGKSGKIHYDDAAIDKLLDRDLVEAEEVSVDDEEENGFLKAFKVANFEYIDEN
EAAALEAQRVAAESKSSAGNSDRASYWEELLKDKFELHQAEELNALGKRKRSRKQLVSIEEDDLAGLED
VSSDGDESYEAESTDGEAAGQGVQTGRRPYRRKGRDNLEPTPLMEGEGRSFRVLGFNQSQRAIFVQTLM
RYGAGNFDWKEFVPRLKQKTFEEINEYGILFLKHIAEEIDENSPTFSDGVPKEGLRIEDVLVRIALLIL
VQEKVKFVEDHPGKPVFPSRILERFPGLRSGKIWKEEHDKIMIRAVLKHGYGRWQAIVDDKELGIQELI
CKELNFPHISLSAAEQAGLQGQNGSGGSNPGAQTNQNPGSVITGNNNASADGAQVNSMFYYRDMQRRLV
EFVKKRVLLLEKAMNYEYAEEYYGLGGSSSIPTEEPEAEPKIADTVGVSFIEVDDEMLDGLPKTDPITS
EEIMGAAVDNNQARVEIAQHYNQMCKLLDENARESVQAYVNNQPPSTKVNESFRALKSINGNINTILSI
TSDQSKSHEDDTKPDLNNVEMKDTAEETKPLRGGVVDLNVVEGEENIAEASGSVDVKMEEAKEEEKPKN
MVVD

Fig. 82.

MSVHVKEEPVLVPNCDVENTELAVFNGNGESELENFGTCVDEITDRVNQLEQKVVEVEHFYSTKDGAAQ
TNTSKSNSGGKKIAISQPNNSKGNSAGKEKSKGKHVSSPDLMRQFATMFRQIAQHKWAWPFLEPVDVKG
LGLHDYYKVIEKPMDLGTIKKKMESSEYSNVREIYADVRLVFKNAMRYNEEKEDVYVMAESLLEKFEEK
WLLIMPKLVEEEKKQVDEEAEKHANKQLTMEAAQAEMARDLSNELYEIDLQLEKLRESVVQRCRVRNRV
FGVVLEINRKLSTQEKKGLSAALGRLSPEDLSKALKMVSESNPSFPAGAPEVELDIDVQTDVTLWRLKV
FVQEALKAANKSSGGTNAQNNNNTGTGEINKNNAKRRREISDAINKASIKRAKKA

Fig. 83.

MVHSESSILSSLRGGDGGGIPCSKDELAINGSYTDPMGRRKSKRFKVAAESEFSPDFGSITRQLRSRRM
QKEFTVETYETRNVSDVCVLSSQADVELIPGEIVAERDSFKSVDCNDMSVGLTEGAESLGVNMQEPMKD
RNMPENTSEQNMVEVHPPSISLPEEDMMGSVCRKSITGTKELHGRTISVGRDLSPNMGSKFSKNGKTAK
RSISVEEENLVLEKSDSGDHLGPSPEVLELEKSEVWIITDKGVVMPSPVKPSEKRNGDYGEGSMRKNSE
RVALDKKRLASKFRLSNGGLPSCSSSGDSARYKVKETMRLFHETCKKIMQEEEARPRKRDGGNFKVVCE
ASKILKSKGKNLYSGTQIIGTVPGVEVGDEFQYRMELNLLGIHRPSQSGIDYMKDDGGELVATSIVSSG
GYNDVLDNSDVLIYTGQGGNVGKKKNNEPPKDQQLVTGNLALKNSINKKNPVRVIRGIKNTTLQSSVVA
KNYVYDGLYLVEEYWEETGSHGKLVFKFKLRRIPGQPELPWKEVAKSKKSEFRDGLCNVDITEGKETLP
ICAVNNLDDEKPPPFIYTAKMIYPDWCRPIPPKSCGCTNGCSKSKNCACIVKNGGKIPYYDGAIVEIKP
LVYECGPHCKCPPSCNMRVSQHGIKIKLEIFKTESRGWGVRSLESIPIGSFICEYAGELLEDKQAESLT
GKDEYLFDLGDEDDPFTINAAQKGNIGRFINHSCSPNLYAQDVLYDHEEIRIPHIMFFALDNIPPLQEL
SYDYNYKIDQVYDSNGNIKKKFCYCGSAECSGRLY

Fig. 84.

MASKGGKSKPDIVMASKSGKSKPDNESRAKRQKTLEAPKEPRRPKTHWDHVLEEMAWLSKDFESERKWK
LAQAKKVALRASKGMLDQASREERKLKEEEQRLRKVALNISKDMKKFWMKVEKLVLYKHQLVRNEKKKK
AMDKQLEFLLGQTERYSTMLAENLVEPYKQGQNTPSKPLLTIESKSDEERAEQIPPEINSCLESGSPEL
DEDYDLKSEDETDEKHFTKRERQEELEALQNEVDLPVEELLRRYTSGRVSRETSPVKDENEDNLTSVSR
VTSPVKDENQDNLASVGQDHGEDKNNLAASEETEGNPSVRRSNDSYGHLAISETHSHDLEPGMTTASVK
SRKEDHTYDFNDEQEDVDFVLANGEEKDDEATLAVEEELAKADNEDHVEEIALLQKESEMPIEVLLARY
KEDFGGKDISEDESESSFAVSEDSIVDSDENRQQADLDDDNVDLTECKLDPEPCSENVEGTFHEVAEDN
DKDSSDKIADAAAAARSAQPTGFTYSTTKVRTKLPFL*LKHSLREYQHIGLDWLVTMYEKKLNGILADEM*
*GLGKTIMTIALLAHLACDKGIWGPHLIVVPTSVMLNWETEFLKWCPAFKILTYFGSAKERKLKRQGWMK*
*LNSFHVCITTYRLVIQDSKMFKRKKWKYLILDEAHLIKNWKSQRWQTLLNFNSKRRILLTGTPLQNDLM*
*ELWSLMHFLMPHVFQSHQEFKDWF*CNPIAGMVEGQEKINKEVIDRLHNVLRPFLLRRLKRDVEKQLPSK
HEHVIFCRLSKRQRNLYEDFIASTETQATLTSGSFFGMISIIMQLRKVCNHPDLFEGRPIVSSFDMAGI
DVQLSSTICSLLLESPFSKVDLEALGFLFTHLDFSMTSWEGDEIKAISTPSELIKQRVNLKDDLEAIPL
SPKNRKNLQGTNIFEEIRKAVFEERIQESKDRAAAIAWWNSLRCQRKPTYSTSLRTLLTIKGPLDDLKA
NCSSYMYSSILADIVLSPIERFQKMIELVEAFTFAIPAARVPSPTCWCSKSDSPVFLSPSYKEKVTDLL
SPLLSPIRPAIVRRQVYFPDRRLIQFDCGKLQELAMLLRKLKFGGHRALIFTQMTKML*DVLEAFINLYG*
*YTYMRLDGSTPPEERQTLMQRFNTNPKIFLFILSTRSGGVGINLVGADTVIFYDSDWNPAMDQQAQDRC*
*HRIGQ*TREVHIYRLISESTIEENILKKANQKRVLDNLVIQNGEYNTEFFKKLDPMELFSGHKALTTKDE
KETSKHCGADIPLSNADVEAALKQAEDEADYMALKRVEQEEAVDNQEFTEEPVERPEDDELVNEDDIKA
DEPADQGLVAAGPAKEEMSLLHSDIRDERAVITTSSQEDDTDVLDDVKQMAAAAADAGQAISSFENQLR
PIDRYAIRFLELWDPIIVEAAMENEAGFEEKEWELDHIEKYKEEMEAEIDDGEEPLVYEKWDADFATEA
YRQQVEVLAQHQLMEDLENEAREREAAEVAEMVLTQNESAHVLKPKKKKKAKKAKYKSLKKGSLAAESK
HVKSVVKIEDSTDDDNEEFGYVSSSDSDMVTPLSRMHMKGKKRDLIVDTDEEKTSKKKAKKHKKSLPNS
DIKYKQTSALLDELEPSKPSDSMVVDNELKLTNRGKTVGKKFITSMPIKRVLMIKPEKLKKGNLWSRDC
VPSPDSWLPQEDAILCAMVHEYGPNWNFVSGTLYGMTAGGAYRGRYRHPAYCCERYRELIQRHILSASD
SAVNEKNLNTGSGKALLKVTEENIRTLLNVAAEQPDTEMLLQKHFSCLLSSIWRTSTRTGNDQMLSLNS
PIFNRQFMGSVNHTQDLARKPWQGMKVTSLSRKLLESALQDSGPSQPDNTISRSRLQETQPINKLGLEL
TLEFPRGNDDSLNQFPPMISLSIDGSDSLNYVNEPPGEDVLKGSRVAAENRYRNAANACIEDSFGWASN
TFPANDLKSRTGTKAQSLGKHKLSASDSAKSTKSKHRKLLAEQLEGAWVRPNDPNLKFDFTPGDREEEE
EQEVDEKANSAEIEMISCSQWYDPFFTSGLDDCSLASDISEIE

Fig. 85.

MVTTRSQEGDGKGKEVELEVPLDSRVTRLETTVAEQHKEMMKQFADLYAVLSRSTAGKMVDEQSTLDRS
APRSSQSMENRSGYPDPYRDARHQQVRSDHFNAYNNLTRLGKIDFPRFDGTRLKEWLFKVEEFFGVDST
PEDMKV*KMAAIHFDSHASTWHQSFIQSGVGLEVLYDWKGYVKLLKERFEDDCDDPMAELKHLQETDGII*
*DYHQKFELIKTRVNLSEEYLVSVYLAGLRT*DTQMHVRMFQPQTVRHCLFLGKTYEKAHPKKPANTTWST
NRSAPTGGYNKYQKEGESKTDHYGNKGNFKPVSQQPKKMSQQEMSDRRSKGLCYFCDEKYTPEHYLVHK
KTQLFRMDVDEEFEDAREELVNDDDEHMPQISVNAVSGIAGYKTMRVKGTYDKKIIFILIDSGSTHNFL
DPNTAAKLGCKVDTAGLTRVSVADGRKLRVEGKVTDFSWKLQTTTFQSDILLIPLQGIDMVLGVQWLET
LGRISWEFKKLEMRFKFNNQKVLLHGLTSGSVREVKAQKLQKLQEDQVQLAMLCVQEVSESTEGELCTI
NALTSELGEESVVEEVLNEYPDIFIEPTALPPFREKHNHKIKLLEGSNPVNQRPYRYSIHQKNEIDKLV
EDLLTNGTVQASSS*PYASPVVLVKKKDGTWRLCVDYRELNGMTVKDSFPIPLIEDLMDELGGAVIFSKI*
*DLRAGYHQVRMDPDDIQKTAFKTHSGHFEYLVMPFGLTNAPATFQGLMNFIFKPFLRKFVLVFFDDILV*
*YSSSLEEHRQHLKQVFEVMRANKLFAKLSKCAFAVPKVEYLGHFISAQGIETDPAKIKAVKEWPQPTTL*
KQLRGFLGLAGYYRRFVRSFGVIAGPLHALTKTDAFEWTAVAQQAFEDLKAALCQAPVLSLPLFDKQFV
VETDACGQGIGAVLMQEGHPLAYISRQLKGKQLHLSIYEKELLAVIFAVRKWRHYLLQSHFIIKTDQRS
LKYLLEQRLNTPIQQQWLPKLLEFDYEIQYRQGKENVVADALSRVEGSEVLHMAMTVVECDLLKDIQAG
YANDSQLQDIITALQRDPDSKKYFSWSQNILRRKSKIVVPANDNIKNTILLWLHGSGVGGHSGRDVTHQ
RVKGLFYWKGMIKDIQAYIRSCGTCQQCKSDPAASPGLLQPLP*IPDTIWSEVSMDFIEGLPVSGGKTVI*
*MVVVDRLSKAAHFIALSHPYSALTVAHAYLDNVFKLHGCPTSIVSDRDVVFTSEFWREFFTLQGVALKL*
*TSAYHPQSDGQTEVVNRCLETYLRCMCHDRPQLWSKWLALAEYWYNTNYHSSSRMTPFEIVYG*QVPPVH
LPYLPGESKVAVVARSLQEREDMLLFLKFHLMRAQHRMKQFADQHRTEREFEIGDYVYVKLQPYRQQSV
VMRANQKLSPKYFGPYKIIDRCGEVAYKLALPSYSQVHPVFHVSQLKVLVGNVSTTVHLPSVMQDVFEK
VPEKVVERKMVNRQGKAVTKVLVKWSNEPLEEATWEFLFDLQKTFPEFEA

Fig. 86.

MAGRGKTLGSGGAKKATSRSSKAGLQFPVGRIARFLKAGKYAERVGAGAPVYLAAVLEYLAAEVLELAG
NAARDNKKTRIVPRHIQLAVRNDEELSKLLGDVTIANGGVMPNIHNLLLPKKAGASKPQED

Fig. 87.

MEPTDSTNEQLGDTKTAAVKEESRSFLGIDLNEIPTGATLGGGCTAGQDDDGEYEPVEVVRSIHDNPDP
APGAPAEVPEPDRDASCGACGRPESIELVVVCDACERGFHMSCVNDGVEAAPSADWMCSDCRTGGERSK
LWPLGVKSKLILDMNASPPSDAEGYGAEETSDSRKHMLASSSCIGNSFDYAMMHSSFSSLGRGHASLEA
SGLMSRNTKMSMDALGSHNLGFGFPLNLNNSSLPMRFPSLDPSELFLQNLRHFISERHGVLEDGWRVEF
RQPLNGYQLCAVYCAPNGKTFSSIQEVACYLGLAINGNYSCMDAEIRNENSLLQERLHTPKRRKTSRWP
NNGFPEQKGSSVSAQLRRFPFNGQTMSPFAVKSGTHFQAGGSLSSGNNGCGCEEAKNGCPMQFEDFFVL
SLGRIDIRQSYHNVNVIYPIGYKSCWHDKITGSLFTCEVSDGNSGPIFKVTRSPCSKSFIPAGSTVFSC
PKIDEMVEQNSDKLSNRRDSTQERDDDASVEILLSEHCPPLGDDILSCLREKSFSKTVNSLRSEVDSSR
VDFDKNLSYDQDHGVEIGDIVVEEDSLSDAWKKVSQKLVDACSIVLKQKGTLNFLCKHVDRETSEINWD
TMNEKDNVILSLSKFCCSLAPCSVTCGEKDKSEFAAVVDALSRWLDQNRFGLDADFVQEMIEHMPGAES
CTNYRTLKSRSSSSVPITVAEGALVVKPKGGENVKDEVFGEISRKAKKPKLNGGHGVRNLHPPPGRPMC
LRLPPGLVGDFLQVSEVFWRFHEILGFEEAFSPENLEQELINPVFDGLFLDKPGKDDKRSEINFTDKDS
TATKLFSLFDESRQPFPAKNTSASELKEKKAGDSSDFKISDSSRGSCVGALLTRAHISLLQVLICELQS
KVAAFVDPNFDSGESRSRRGRKKDDSTLSAKRNKLHMLPVNEFTWPELARRYILSLLSMDGNLESAEIA
ARESGKVFRCLQGDGGLLCGSLTGVAGMEADSMLLAEAIKKISGSLTSENDVLSVEDDDSDGLDATETN
TCSGDIPEWAQVLEPVKKLPTNVGTRIRKCVYEALERNPPEWAKKILEHSISKEIYKGNASGPTKKAVL
SLLADIRGGDLVQRSIKGTKKRTYISVSDVIMKKCRAVLRGVAAADEDKVLCTLLGRKLLNSSDNDDDG
LLGSPAMVSRPLDFRTIDLRLAAGAYDGSTEAFLEDVLELWSSIRVMYADQPDCVDLVATLSEKFKSLY
EAEVVPLVQKLKDYRKLECLSAEMKKEIKDIVVSVNKLPKAPWDEGVCKVCGVDKDDDSVLLCDTCDAE
YHTYCLNPPLIRIPDGNWYCPSCVIAKRMAQEALESYKLVRRRKGRKYQGELTRASMELTAHLADVMEE
KDYWEFSAEERILLLKLLCDELLSSSLVHQHLEQCAEAIIEMQQKLRSLSSEWKNAKMRQEFLTAKLAK
VEPSILKEVGEPHNSSYFADQMGCDPQPQEGVGDGVTRDDETSSTAYLNKNQGKSPLETDTQPGESHVN
FGESKISSPETISSPGRHELPIADTSPLVTDNLPEKDTSETLLKSVGRNHETHSPNSNAVELPTAHDAS
SQASQELQACQQDLSATSNEIQNLQQSIRSIESQLLKQSIRRDFLGTDASGRLYWGCCFPDENPRILVD
GSISLQKPVQADLIGSKVPSPFLHTVDHGRLRLSPWTYYETETEISELVQWLHDDDLKERDLRESILWW
KRLRYGDVQKEKKQAQNLSAPVFATGLETKAAMSMEKRYGPCIKLEMETLKKRGKKTKVAEREKLCRCE
CLESILPSMIHCLICHKTFASDDEFEDHTESKCIPYSLATEEGKDISDSSKAKESLKSDYLNVKSSAGK
DVAEISNVSELDSGLIRYQEEESISPYHFEEICSKFVTKDCNRDLVKEIGLISSNGIPTFLPSSSTHLN
DSVLISAKSNKPDGGDSGDQVIFAGPETNVEGLNSESNMSFDRSVTDSHGGPLDKPSGLGFGFSEQKNK
KSSGSGLKSCCVVPQAALKRVTGKALPGFRFLKTNLLDMDVALPEEALRPSKSHPNRRRAWRVFVKSSQ
SIYELVQATIVVEDMIKTEYLKNEWWYWSSLSAAAKISTLSALSVRIFSLDAAIIYDKPITPSNPIDET
KPIISLPDQKSQPVSDSQERSSRVRRSGKKRKEPEGS

Fig. 88.

MVLLSFSLRFIAFTLTITLTQIADGFQSRMLMNNGLALSPQMGWNSWNHFQCNINETLIKQTADAMVSS
GLSAI GYKYINIDDCWGELKRD SQGSLVAKASTFPSGIKALSDYVHSKGLKLGIYSDAGTLTCSQTMPG
SLGHEEQDAKTFASWGIDYLKYDNCENTGTSPRERYPKMSKALLNSGRSIFFSLCEWGQEDPATWAGDI
GNSWRTTGDIQDNWKSMTLIADQNDRWASYARPGSWNDPDMLEVGNGGMTKEEYMSHFSIWALAKAPLL
IGCDLRSMDKVTFELLSNKEVIAVNQDKLGIQGKKVKKEGDLEVWAGPLSKKRVAVILWNRGSASANIT
ARWAEIGLNSSDIVNARDLWEHSTYSCVKKQLSALVEPHACKMYTLTRRKA

Fig. 89.

MAENTASHRRKPRSLNDRHYSILQDLSAPPRQPPSSSHGEDEETKKSMIKLAGRRRLCKALPKEDEADG
YDDPDLVDFYSPVKGETSLDSAGIGNKFTSWDESKEANTELAGEPNFSIITDFCSPSPQLKQKEEMQGD
GGRNEIMGILDDLTSKLGTMSIQKKKDSQSNDFDACGVKSQVDKFDFEDAKSSFSLLSDLSKSSPDVVT
TYNAGVNSIKDKQGKSGFAIREEQTSKEFSREWEERISNVGKQNSYSGRHFDDNSEDNRQGYNLDRGKS
QCKEVDQSMKTTRHIEVSEKIRTVGRSNAAKLRDLDEDDDDDCLILSGKKAAEMKINKPARSYNAKRH
GYDERSLEDEGSITLTGLNLSYTLPG*KIATMLYPHQREGLNWLWSLHTQGKGGILGDDMGLGKTMQICS*
*FLAGLFHSKLIKRALVVAPKTLLPHWMKELATVGLSQMTREYYGTSTKAREYDLHHILQGKGILLTTYD*
*IVRNNTKALQGDDHYTDEDDEDGNKWDYMILDEGHLIKNPNTQRAKSLLEIPSSHRIIISGTPIQNNLK*
*ELWALFNFSCPGLLGDKNWFKQN*YEHYILRGTDKNATDREQRIGSTVAKNLREHIQPFFLRRLKSEVFG
DDGATSKLSKKDEIVVWLRLTACQRQLYEAFLNSEIVLSAFDGSPLAALTILKKICDHPLLLTKRAAED
VLEGMDSTLTQEEAGVAERLAMHIADNVDTDDFQTKNDSISCKLSFIMSLLENLIPEGHRVLIFSQTRK
ML*NLIQDSLTSNGYSFLRIDGTTKAPDRLKTVEEFQEGHVAPIFLLTSQVGGLGLTLTKADRVIVVDPA*
*WNPSTDNQSVDRAYRIGQ*TKDVIVYRLMTSATVEEKIYRKQVYKGGLFKTATEHKEQIRYFSQQDLREL
FSLPKGGFDVSPTQQQLYEEHYNQIKLDEKLESHVKFLETLGIAGVSHHSLLFSKTAPIQAIQKDEEEQ
IRRETALLLGRASASISQDTVINGADYAFKPKDVNLDKRINISPVDDKELSESVIKARLNRLTMLLQNK
GTVSRLPDGGAKIQKQIAELTRELKDMKAAERINMPQVIDLEEDISRKMQKGLNL

Fig. 90.

MDWIHKSTPFMEPSNLAKLVQGNVPLQPHDSHSSLTDLDMDLREVYFLILHFLSIGPCERTFGHLRDEI
LEKGLLPRRYHSWWSRSGIYSGRADDDGISLPLSYDNLIERYPHIEKDHLVKLLKQLILNPSFPSHMRV
EGNAPNAADVPTLLGSGTFSLVDRSNSYSSTLSNMFLWIWDLKKSHICIEPDSGSKALHFRNLFFWLWQ
SLLGIMTCIGNSGEVAHIGEVKSRGNNIESQKARHVASYLRWPHMHADQVRGLSLREIGGGFRKHHRAP
SILSACHAIAKPSTMVQK*MQN*IKKLRGHRNAVYCAIFDRSGRYVITGSDDRLVKIWSMETALCLASCRG
HEGDITDLAVSSNNALVASASNDFVIRVWRLPDGMPISVLRGHTGAVTAIAFSPRQASVYQLLSSSDDG
TCRIWDARYSQWLPRIYVPSPSDANTGSLEVSLLGESTFTSSNTGSTSNASQSHQILCCAYNANGTIFV
TGSSDSNARVWSASKPNLDDAEQPTHELDVLRGHENDVNYVQFSGCAVAPKSSTADALKEDSYPKFKNS
WFCHDNIVTCSRDGSAIIWTPRSRKFHGKSGRWMKGYHLKVPPPPLPPQPPRGGPRQRFLPTPRGVNMI
IWSLDNRFVLAAIMDCRICVWNAADGSLVHCLTGHSESSYVLDVHPFNPRIAMSAGYDGKTIIWDIWEG
IPIKVYEIGRFKLVDGKFSQDGTSIVLSDDVGQIYFLNTGQGESQKNAKYDQFFLGDYRPLIRDTNGHV
LDQETQLLPHRRNLQDLLCDSSMIPYPEPDQTMFQQRRLGALGVEWRPSSIKFSVGPDFSLGQDYIMPP
LADLDRLIEPLPEFIDAMYWEPEHEVLSDDNDSEYNAEVSSDGARASPCSNSSNELECSSEDSDVENIH
ESSYHWKRRRKHPKVNVSTSSGRRDKRILDENDSSNSGIKRTKNRRIVVKASKRKHSDVKASRPQRAAA
QNARSLLSKISGSSSDEVDDDNDSSNSESDRSIPTLRQLDKPSQMLESLSNDKQKKRLIVKISVKKPAE
SMGSKGDVINQADLEQLSSKPLEENHRVIGIYSREPGSSSVDAKGDSGCQSIPYSMNTPQREKADNQLI
RSSDQDQNMCKWREEIPVCEPTELTAPENIEEAQPFYGDEADEILPKKVRRLRLKLRHPNSPRKLEPDE
VADDLADGGDGFASIAPSFMNPIMDSEPVIDSVRDSSAHNFEFGEATADVIRRKRSIRSESSTRNSALR
IRLGSGSVDKIKKQGIPSTSVYDDASLEEWPSTSKAGSRSRSASVSKPSLHTGIRLNSVSGKISWLLLS
EHEEGCRYIPQLGDEVIYFKQGHQEFLKTKELNDRDRSRYLPRNLGAVEICKVEKLNYDTYPGSGDSCC
KMTLRVLDSSSSHASRKEFQLTLPELINFPDFIVEKTRYDAAIQTNWKIGNECRVWWRDATGEGGAWWE
GRIESSQVKSTDFPESPWERYRVVYETGETSLHSPWEFDNPEFPWEKSTI*EDERREKLLSLFAGLVKSI*
*SKHQDSYGIQKLNEAAQKMDFCNRFPVPLYPELIHERLENQYYRSIESFKHDVDAMLSNAELYFVRSAH*
*MLSKIKRLRDKLTKTLRKLI*

Fig. 91.

MVGLEDDTERERSPVVENGFSNGSRSSSSSAGVLSPSRKVTQGNDTLSYANILRARNKFADALALYEAM
LEKDSKNVEAHIGKGICLQTQNKGNLAFDCFSEAIRLDPHNACALTHCGILHKEEGRLVEAAESYQKAL
MADASYKPAAECLAIVLTDLGTSLKLAGNTQEGIQKYYEALKIDPHYAPAYYNLGVVYSEMMQYDNALS
CYEKAALERPMYAEAYCNMGVIYKNRGDLEMAITCYERCLAVSPNFEIAKNNMAIALTDLGTKVKLEGD
VTQGVAYYKKALYYNWHYADAMYNLGVAYGEMLKFDMAIVFYELAFHFNPHCAEACNNLGVLYKDRDNL
DKAVECYQMALSIKPNFAQSLNNLGVVYTVQGKMDAAASMIEKAILANPTYAEAFNNLGVLYRDAGNIT
MAIDAYEECLKIDPDSRNAGQNRLLAMNYINEGLDDKLFEAHRDWGWRFTRLHPQYTSWDNLKDPERPI
TIGYISPDFFTHSVSYFIEAPLTHHDYTKYKVVVYSAVVKADAKTYRFRDKVLKKGGVWKDIYGIDEKK
IASMVREDKIDILVELTGHTANNKLGTMACRPAPVQVTWIGYPNTTGLPTVDYRITDSLADPPDTKQKQ
VEELVRLPDCFLCYTPSPEAGPVCPTPALSNGFVTFGSFNNLAKITPKVLQVWARILCAVPNSRLVVKC
KPFCCDSIRQRFLTTLEQLGLESKRVDLLPLILFNHDHMQAYSLMDISLDTFPYAGTTTTCESLYMGVP
CVTMAGSVHAHNVGVSLLTKVGLGHLVAKNEDEYVQLSVDLASDVTALSKLRMSLRDLMAGSPVCNGPS
FAVGLESAYRNMWKKYCKGEVPSLRRMEMLQKEVHDDPLISKDLGPSRVSVTGEATPSLKANGSAPVPS
SLPTQSPQLSKRMDSTS

Fig. 92.

MGTKVSDDLVSTVRSVVGSDYSDMDIIRALHMANHDPTAAINIIFDTPSFAKPDVATPTPSGSNGGKRV
DSGLKGCTFGDSGSVGANHRVEEENESVNGGGEESVSGNEWWFVGCSELAGLSTCKGRKLKSGDELVFT
FPHSKGLKPETTPGKRGFGRGRPALRGASDIVRFSTKDSGEIGRIPNEWARCLLPLVRDKKIRIEGSCK
SAPEALSIMDTILLSVSVYINSSMFQKHSATSFKTASNTAEESMFHPLPNLFRLLGLIPFKKAEFTPED
FYSKKRPLSSKDGSAIPTSLLQLNKVKNMNQDANGDENEQCISDGDLDNIVGVGDSSGLKEMETPHTLL
CELRPYQKQALHWMTQLEKGNCTDEAATMLHPCWEAYCLADKRELVVYLNSFTGDATIHFPSTLQMARG
GILADAMGLGKTVMTISLLLAHSWKAASTGFLCPNYEGDKVISSSVDDLTSPPVKATKFLGFDKRLLEQ
KSVLQNGGNLIVCPMTLLGQWKTEIEMHAKPGSLSVYVHYGQSRPKDAKLLSQSDVVITTYGVLTSEFS
QENSADHEGIYAVRWFRIVLDEAHTIKNSKSQISLAAAALVADRRWCLTGTPIQNNLEDLYSLLRFLRI
EPWGTWAWWNKLVQKPFEEGDERGLKLVQSILKPIMLRRTKSSTDREGRPILVLPPADARVIYCELSES
ERDFYDALFKRSKVKFDQFVEQGKVLHNYASILELLLRLRQCCDHPFLVMSRGDTAEYSDLNKLSKRFL
SGKSSGLEREGKDVPSEAFVQEVVEELRKGEQGE⌐CPICLEALEDAVLTPCAHRLCRECLLASWRNSTSG
LCPVCR¬NTVSKQELITAPTESRFQVDVEKNWVESSKITALLEELEGLRSSGSKSILFSQWTAFL*DLLQI*
*PLSRNNFSFVRLDGTLSQQQREKVLKEFSEDGSILVLLMSLKAGGVGINLTAASNAFVMDPWWNPAVEE*
*QAVMRIHRIGQ*TKEVKIRRFIVKGTVEERMEAVQARKQRMISGALTDQEVRSARIEELKMLFT

Fig. 93.

MGSSHIPLDPSLNPSPSLIPKLEPVTESTQNLAFQLPNTNPQALISSAVSDFNEATDFSSDYNTVAESA
RSAFAQRLQRHDDVAVLDSLTGAIVPVEENPEPEPNPYSTSDSSPSVATQRPRPQPRSSELVRITDVGP
ESERQFREHVRKTRMIYDSLRMFLMMEEAKRNGVGGRRARADGKAGKAGSMMRDCMLWMNR*DKRIVGSI*
*PGVQVGDIFFFRFELCVMGLHGHPQSGIDFLTGSLSSNGEPIATSVIVSGGYEDDDDQGDVIMYTGQGG*
*QDRLGRQAEHQRLEGGNLAMERSMYYGIEVRVIRGLKYENEVSSRVYVYDGLFRIVDSWFDVGKSGFGV*
*FKYRLERIEGQ*AEMGSSVLKFARTLKTNPLSVRPRGYINFDISNGKENVPVYLFNDIDSDQEPLYYEYL
AQTSFPPGLFVQQSGNASGCDCVNGCGSGCLCEAKNSGEIAYDYNGTLIRQKPLIHECGSACQCPPSCR
NRVTQKGLRNRLEVFRSLETGWGVRSLDVLHAGAFICEYAGVALTREQANILTMNGDTLVYPARFSSAR
WEDWGDLSQVLADFERPSYPDIPPVDFAMDVSKMRNVACYISHSTDPNVIVQFVLHDHNSLMFPRVMLF
AAENIPPMTELSLDYGVVDDWNAKLAICN

Fig. 94.

MVVETIERSCEGSKRRHVNGGDIAVPCSGEECSNGDINVAPGVSAKRARVSREMTFEDIYGADALLNDD
DDEDDDCDWEPVQAPMEFVKWCCVNCTMSNPGDMVHCCICGEHKESGILRHGYLASPFFKDTGLIEVEE
KYGGSSSATSSTAVGFDERMLLHSEFEVKAQPHPERPDRLRAIAASLATAGVFPGRCLPINAREITKQE
LQMVHTSEHVDAVDTTSQLLYSYFTSDTYANEYSARAARLAAGLCADLATDIFTGRVKNGFALVRPPGH
HAGVRHAMGFCLHNNAAVAALVAQAAGAKKVLIVDWDVHHGNGTQEIFEQNKSVLYISLHRHEGGNFYP
GTGAADEVGSNGGEGYCVNVPWSCGGVGDKDYIFAFQHVVLPIASAFSPDFVIISAGFDAARGDPLGCC
DVTPAGYSRMTQMLGDLCGGKMLVILEGGYNLRSISASATAVIKVLLGENPENELPIATTPSVAGLQTV
LDVLNIQLEFWPSLAISYSKLLSELEARLIENKKNQMKRKVVRVPTWWKWGRKKLLYNFLSARMISRSK

Fig. 95.

MGRGRVELKRIENKINRQVTFAKRRNGLLKKAYELSVLCDAEVALIIFSNRGKLYEFCSSSNMLKTLDR
YQK<u>CSYGSIEVNNKPAKELENSYREYLKLKGRYENLQRQQRNLLGEDLGPLNSKELEQLERQLDGSLKQ
VRSIKTQYMLDQLSDLQNKEQMLLETNRALAMKLDD</u>MIGVRSHHMGGGGGWEGGEQNVTYAHHQAQSQG
LYQPLECNPTLQMGYDNPVCSEQITATTQAQAQQGNGYIPGWML

Figure 96.

MEQYEILEQIGKGSFGSALLVRHKHEKKKYVLKKIRLARQTDRSRRSAHQEMELISKLRNPFIVEYKDS
WVEKGCYVCIIIGYCEGGDMAEAIKKANSIHFPEEKLCKWLVQLLMALDYLHMNH`ILHRDVKCSNIFL`T
KDRDIRLGDFGLAKMLTSDDLA

Figure 97.

MESRMDHYEIMEQIGRGAFGAAILVYHKSEKKKYVLKKIRLARQTERCRRSAHQEMALIARVQHPYIVE
FKEAWVEKGCYVCIVTGYCEGGDMAELMKKSNGLHFPEEKLCKWFTQLLLAVEYLHSNF`VLHRDLKCSN
IFL`

Figure 98.

MMPEQWVQDERELKRQ`KRKQSNRESARRSRLR`KQAECEELQARVQTLNNENRTLRDELQRLSEECEKLT
SENSSIKEELTRFCGPEALANFEKGNAAPPAQSRGGE

Figure 99.

EDNNGSLALGMFMGNQITENKNMVSNQNQNPVFLGTGVVRSSQPQQQQQPLFPKPANVTFASSMNLVNN
PQLTNGSGTNLVVAPKPPLHDALIQGTGIGAIGLGTRGVTVASRSPTSTISSDVITKSSIEASSFSPVP
FSFGRGRRSSGALEKVVERRQ`RRMIKNRESAARSRAR`KQAYTLELEAEVAKLKEMNQELQKKQREIMET
QKNQVLEKMKYQLGGKRFCLRRTLTGPW

Figure 100.

QPGEVTSLQYLIPSNLSPYATHFPMAQNNLSTMQLNELSNPLYNFQGSSQFQDFNRHPCLSSNSTSDEA
DEQQQSLIDERKQ`RRMVSNRESARRSRMR`KQKHLDELWSQVVWLRNENHQLIDKLNQVSDCHDKVVQEN
AQLKEQTSELRQMITELQVNNPYPKFRELEEIPPNTPSES

Figure 101.

MKRSASELALEEFLKKAAVISPQVTDADADADDDVFNLEREEEVIRSPKRGKNFPDSACFFGDIDFSYF
LVKNNREIMDAIVNRGAGLTEATIDSQSSIVSSPTSGSNLMGRERGRGNNSGSSEDQSDDEIEAGSYEQ
STDPLASKKI`RRMISNRESARRSRRR`KQAQLSELESQVKQLKGENETLFNQLLDASQHYHDANTNNRVL

Figure 102.

AEPKGPVQPAEHRGQTSSGFQFGLQAPGQVALGSDRGTSTKESDANGSPLGIPSLPAMPKKQGLQTAQT
TSGSSRDESDDDDLEGDIENSENMHPSDARRARRMLSNRESARRSRRRKQAHLNDLETQVGQLRVDHST
LLKCLTDVNQKYDDAAVDNRILKADIETLRAKVKMSEETVKRLTGVNPLLVAMSQSQMPFVSSQMPMQS
NSQ

Figure 103.

MASIPRKSSPGSNGGSQPA<u>IPDERKR</u>KRMQSNRESARRSRMKKQKQVEDLTGELSRLQMANNQLLQSIG
AKEQAFVXVDNMNNVLRSQAIELADRLRSL

Figure 104.

KRSASELALEEFLKKAAVISPQVTDADADADDDVFNLEREEEVIRSPKRGKNFPDSACFFGDIDFSYFL
VKNNREIMDAIVNRGAGLTEATIDSQSSIVSSPTSGSNLMGRERGRGNNSGSSEDQSDDEIEAGSYEQS
TDP<u>LASKKI</u>RRMISNRESARRSRRRKQAQLSELESQVKQLKGENETLFNQLLDASQHYHDANTNNRVL

Figure 105.

KRSASELALEELLEKTTVDALKVEPDEEVSVSRSPKRSKSFQDSADACNFFRDIDFNFFFTNNPEIMDA
IVNCGGGLAEGPLWAQNLTPKLSSISATIDSQSSFVSSPTSGSNMMSREHQRDNNSGSSEDQSDDEVEE
PGSYGQTTD<u>PLSLKKM</u>RRMISNRDSARRSRRRKQAHLAELESQMNQLKVENETLFNQLLDATQQYRDAN
<u>TNNRVL</u>KSDVNAMRAKVKLAEDTLA

Figure 106.

MDAIVNCGGGLAEGPLWAQNLTPKLSSISATIDSQSSFVSSPTSGSNMMSREHQRDNNSGSSEDQSDDE
VEEPGSYGQTTD<u>PLSLKKM</u>RRMISNRDSARRSRRRKQAHLAELESQMNQLKVENETLFNQLLDATQQYR
DANTNNRVLKSDVNAMRAKVKLAEDTLA

Figure 107.

MAVTSSP<u>REEYVYMAKLAEQAERYEEMVEFMEKVSAAADDEELTVEE</u>RNLLSVAYKNVIGARRASWRII
SSIEQKEESRGNDDHVSVIRGYRSKIETELSNICDGILKLLDSRLISSAASGDSKVFYLKMKGDYHRYL
AEFKTGAERKEAAESTLTAYKSAQDIANSELAPTHPIRLGLALNFSVFYYEILNSPDRACSLAKQAFDE
AIAELDTLGEESYKDSTLIMQLLRDNLTLWTSDMQDDGDEIKEAAPKRDDE

Figure 108.

MAAAPSV<u>REENVYMAKLAEQAERYEEMVEFMEKVSASLDKEELTVEE</u>RNLLSVAYKNVIGARRASWRII
SSIEQKEESRGNDDHVSVIRDYRSKIETELSNICDGILKLLDSRLIPSAASGDSKVFYLKMKGDYHRYL
AEFKTGAERKEAAESTLTAYKAAQDIANSELPPTHPIRLGLALNFSVFYYEILNSPDRACSLAKQAFDE
AIAELDTLGEESYKDSTLIMQLLRDNLTLWTSDMQDDGADEIKEAPPKREDEKQ

Figure 109.

MAAAVPENLSREQYVYLAKLAEQAERYEEMVQFMQKLVLGSTPGSELSVEE RNLLSVAYKNV IGSLRAA
WRIVSSIEQKEESRKNEEHVVLVKDYRSKVESELSDVCASILQLLDSNLIPSASASESKVFYLKMKGDY
HRYLAEFKVGDERKAAAEDTMLAYRAAQDVAVADLAPTHPIRLGLALNFSVFYFEILNQSDKACSMAKE
AFEEAIAELDTLGEES YKDSTLIMQLLRDNLTLWTS DAQDQLDES

Figure 110.

MAKERELLVYSAKLAEQAERYEEMVEEMKKIAKLNVELTVEE RNLLSVGYKNV IGARRASWRILSSIEQ
KETTKHNEKNVERIIGYRHGVEDELSKICSDILSIIDQHLLPCSSAGESTVFYHKMKGDYCRYLAEFKS
GDEHKQVADQSLKSYEAASAIANSDLSPTHPIRLGLALNFSVFYYEILNSPERACHLAKQAFDEAIAEL
DSLNEESYKDITLIMQLLRDNLTLWTSDLADEGEQSNADEL

Figure 111.

MASLIPENLTREQYVYLSKLSEQAERYEEMVDFMQKLVLTSTPASELTVEE RNLLSVAYKNV IGSLRAA
WRIVSSIEQKEEGRKNEDHVVLVKDYRSKVESELTEVCANILKLLDSNLIPSSSSGESEVFYLKMKGDY
HRYLAEFKIGEERKSAAEDTMLAYKAAQDIAVADLAPTHPIRLGLALNFSVFYFEILNQS

Figure 112.

MAVASSPREEYVYLAKLAEQAERYEEMVEFMEKVSAAVDNEELTVEE RNLLSVAYKNV IGARRASWRII
SSIEQKEESRGNDDHVSIIRDYRSKIETELSNICDGILNLLDSRLIPSAASGDSKVFYLKMKGDYHRYL
AEFKTGAKRKESAESTLTAYKSAQDIANAELSPTHPIRLGLALNFSVFYYEILNSPDRACSLAKQAFDE
AIAELDTLGEES YKDSTLIMQLLRDNLTLWTS DMQDDG

Figure 113.

MATAPSLREENVYMAKLAEQAERYEEMVEFMEKVSASIDKEELTVEE RNLLSVAYKNV IGARRASWRII
SSIEQKEESRGNDHHVSVIRDYRSKIESELSNICDGILKLLDSRLIPSAASGDSKVFYLKMKGDYHRYL
AEFKTGAERKEAAESTLTAYKAAQDIANAELPPTHPIRLGLALNFSVFYYEILNSPDRACSLAKQAFDE
AIAELDTLGEESYKDSTLIMQLL

Figure 114.

MAASVPDNLSREQYVYLAKLAEQAERYEEMVQFMQKLVLGSTPGSELSVEE RNLLSVAYKNV IGSLRAA
WRIVSSIEQKEESRKNEEHVVLVKDYRSKVESELSEVCASILKLLDSNLIPSACASESKVFYLKMKGDY
HRYMAEFKAGDERKAAAEDAMLAYRDALDVAVADLAPTHPIRLGLALNFSVFYFEILNQSDKACSMAKE
AFEEAIAELDTLGEES YKDSTLIMQLLRDNLTLWTS DAQDQLDES

Figure 115.

MAVASSPREKYVYMAKLAEQAERYEEMVEFMEKVSAAIENEELTVEE RNLLSVAYKNV IGARRASWRII
SSIEQKEESRGNDDHVSVIREYRSKIESELSNICDGILKLLDSRLISSAASGDSKVFYLKMKGDYHRYL
AEFKTGAERKEAAESTLTAYKSAQDIANSELAPTHPIRLGLALNFSVFYYEILNSPDRACSLAKQAFDE
AIA

Figure 116.

MSSAEKERETQVYMAKLAEQAERYDEMVEYMKNIAKLDLELTVEE RNLLSVGYKNV IGARRASWRIMSS
IEQKEESKGNENIVKLIKSYRQKVEEELSKICGDILSIIDKHLIPHSSAAEATVFYYKMKGDYYRYLAE
FKTDQDRKEAADQSLKGYEAASGTANTELPSTHPIRLGLALNFSVFYYEIMNSPERACHLAKQAFDEAI
AELDTLSEES YKDSTLIMQLLRDNLTLWTS DLPEDGGDENFKAEESKPAEPEAQQGK

Figure 117.

MASSKERENFVYVAKLAEQAERYDEMVEAMKNVAKLEVELTVEE RNLLSVGYKNV VGARRASWRILSSI
EQKEEAKGNEANAKRIKEYRQKVETELSGICDDIMTVIDEHLIPLASAGESTVFYYKMKGDYYRYLAEF
KSGNEKKEAADQSMKAYEAATSSAESELPPTHPIRLGLALNFSVFYYEILNSPERACHLAKQAFDEAIS
ELDTLNEES YKDSTLIMQLLRDNLTLWTS DIPEDGDDAQKTNGTAKISGGDDAE

Figure 118.

MASSRERENFVYIAKLAEQAERYDEMVDAMKNVAKLDVELTVEE RNLLSVGYKNV VGARRASWRILSSI
EQKEEAKGNETNAKRIKEYRQKVETELSGICTDIMTVIDEHLIPSASAGESTVFYYKMKGDYYRYLAEF
KSGNEKKDAADQSMKAYEAATSSAESELPPTHPIRLGLALNFSVFYYEILNSPERACHLAKQAFDGAIS
ELDTLNEES YKDSTLIMQLLRDNLTLWTS DIPEDGDDAQKVNGTVKVAGGVDE

Figure 119.

MSTVDSSREENVYLAKLAEQAERYEEMVEFMEKVAKTVDVEELTVEE RNLLSVAYKNV IGARRASWRII
SSIEQKEESRGNEDHVAIIKEYRGKIETELSKICDGILSLLESHLIPSASSAESKVFYLKMKGDYHRYL
AEFKTGAERKEAAESTLLAYKSAQDIALAELAPTHPIRLGLALNFSVFYYEILNSPDRACNL

Figure 120.

MAAAAAPSVREENVYMAKLAEQAERYEEMVDFMEKVSASLDKEELTVEE RNLLSVAYKNV IGARRASWR
IISSIEQKEESRGNDDHVSVIRGYRSKIEKELSDICDGILKLLDSRLIPSAASGDSKVFYLKMKGDYHR
YLAEFKTSAERKEAAESTLTAYKAAQDIANAELPPTHPIRLGLALNFSVFYYEILNSPDRA

Figure 121.

```
MEHYEVLEQIGKGSFGSALLVRHKHEKKLYVLKKIRLARQTGRTRRSAHQEMELISKIRNPFIVEYKDS
WVEKGCYVCIVIGYCKGGDMAEAIKKANGVEFSEEKLCKWLVQLLMALEYLHASHILHRDVKCSNIFLT
KDQDIRLGDFGLAKILTSDDLASSVVGTPSYMCPELLADIPYGSKSDIWSLGCCMYEMTALKPAFKAFD
MQGLINRINRSIVAPLPAQYSTAFRSLVKSMLRKNPELRPSASDLLRQPLLQPYVQKVLLKLSFREHDT
LPSESERRSSYPQQRKRTSGKSVSFGPSRFGVDQEDSVSSVKPVHTYLHRHRPVDLSANDTSRVVVRRP
AVSSVVSNSSKYVPVRSNQPKSGGLLKPAVVTRRASLPISQKPAKGTKDSLYHPNIGILHQLNSPDVSV
NSPRIDRIKFPLASYEEMPFIPVVRKKKGSSRGSYSPPPEPPLDCSITKDKFTLEPERETKSDLSDQNA
TAGASSRASSGASRRQRFDPSSYRQRAEALEGLLEFSARLLIDERYDELNVLLKPFGPGKVSPRETAIW
LSKSFKESSPSNLEED
```

Figure 122.

```
MESRMDQYELMEQIGRGAFGAAILVHHKAERKKYVLKKIRLARQTERCRRSAHQEMSLIARVQHPYIVE
FKEAWVEKGCYVCIVTGYCEGGDMAELMKKSNGVYFPEEKLCKWFTQLLLAVEYLHSNYVLHRDLKCSN
IFLTKDQDVRLGDFGLAKTLKADDLTSSVVGTPNYMCPELLADIPYGFKSDIWSLGCCIYEMAAYRPAF
KAFDMAGLISKKSTHQGNVKEEPRVSAKRMASEILKHPYLQPYVEQYRPTLSAASITPEKPLNSREGRR
SMAESQNSNSSSEKDNFYVSDKNIRYVVPSNGNKVTETDSGFVDDEDILDHVQQSAENGNLQSVSATKP
DGHGILKPVHSDQRPDVIQPRHPKTIRNIMMVLKEEKARENGSPMRSNRSRPSSVPTQKNNVETPSKIP
KLGDIAHSSKTNASTPIPPSKLASDSARTPGSFPPKHHMPVIDSSPKLKPRNDRISPSPAAKHEAEEAM
SVKRRQRTPPTLPRRTSLIAHQSRQLGADISNMAAKETAKLHPSVPSESETNSHQSRVHASPVSTTPEP
KRTSVGSAKGMQSESSNSISSSLSMQAFELCDDASTPYIDMTEHTTPDDHRRSCHSEYSYSFPDISSEM
MIRRDEHSTSMRLTEIPDSVSGVQNTIAHHQPEREQGSCPTVLKDDSPATLQSYEPNTSQHQHGDDKFT
VKEFVSSVPGPAPLPLHVEPSHQVNSHSDNKTSVMSQNSALEKNNSHSHPHPVVDDVIHVIRHSSFRVG
SDQPVMESVEVGVQNVDMGKLINVVRDEMEVRKGATPSESPTTRSIISEPDSRTEPRPKEPDPITNYSE
TKSFNSCSDSSPAETRTNSFVPEEETTPTPPVKETLDIKSFRQRAEALEGLLELSADLLEQSRLEELAI
VLQPFGKNKVSPRETAIWLAKSLKGMMIEDINNNNSSGSSRNCS
```

Figure 123.

```
MGTSEDKMPFKTTKPTSSAQEVPPTPYPDWQNSMQAYYGGGGTPNPFFPSPVGSPSPHPYMWGAQHHMM
PPYGTPVPYPAMYPPGAVYAHPSMPMPPNSGPTNKEPAKDQASGKKSKGNSKKKAEGGDKALSGSGNDG
ASHSDESVTAGSSDENDENANQQEQGSIRKPSFGQMLADASSQSTTGEIQGSVPMKPVAPGTNLNIGMD
LWSSQAGVPVKDERELKRQKRKQSNRESARRSRLRKQAECEQLQQRVESLSNENQSLRDELQRLSSECD
KLKSENNSIQDELQRVLGAEAVANLEQNAAGSKDGEGTN
```

Figure 124.

```
MASNEMEKSSKEKEPKTPPPSSTAPPSSQEPSSAVSAGMATPDWSGFQAYSPMPPPHGYVASSPQPHPY
MWGVQHMMPPYGTPPHPYVAMYPPGGMYAHPSMPPGSYPYSPYAMPSPNGMTEVSGNTTGGTDGDAKQS
EVKEKLPIKRSRGSLGSLNMITGKNNEPGKNSGASANGAYSKSGESASDGSSEGSDGNSQNSSLLFFHS
AEAASENGGSANGPQNGSAGTPILPVSQTVPIMPMTAAGVPGPPTNLNIGMDYWGAPTSAGIPGMHGKV
STPVPGVVAPGSRDGGHSQPWLQDDRELKRQRRKQSNRESARRSRLRKQAECDELAQRAEVLNEENTNL
RAEINKLKSQCEELTTENTSLKDQLSLFPPLEGISMDNDHQEPDTNQTGAAERKVDSYKDST
```

Figure 125.

MQPQTDVFSLHNYLNSSILQSPYPSNFPISTPFPTNGQNPYLLYGFQSPTNNPQSMSLSSNNSTSDEAE
EQQTNNNIINERKQRRMISNRESARRSRMRKQRHLDELWSQVMWLRIENHQLLDKLNNLSESHDKVLQE
NAQLKEETFELKQVISDMQIQSPFSCFRDDIIPIE

Figure 126.

MDNHTAKDIGMKRSASELALQEYLTTSPLDPCFDLMNRDYTCELRDSLLWSEGLFPAGPFRDAQSSICE
NLSADSPVSANKPEVRGGVRRTTSGSSHVNSDDEDAETEAGQSEMTNDPNDLKRIRRMNSNRESAKRSR
RRKQEYLVDLETQVDSLKGDNSTLYKQLIDATQQFRSAGTNNRVLKSDVETLRVKVKLAEDLVARGSLT
SSLNQLLQTHLSPPSHSISSLHYTGNTSPAITVHSDQSLFPGMTLSGQNSSPGLGNVSSEAVSCVSDIW
P

Figure 127.

MNSIFSIDDFSDPFWETPPIPLNPDSSKPVTADEVSQSQPEWTFEMFLEEISSSAVSSEPLGNNNNAIV
GVSSAQSLPSVSGQNDFEDDSRFRDRDSGNLDCAAPMTTKTVIVDSDDYRRVLKNKLETECATVVSLRV
GSVKPEDSTSSPETQLQPVQSSPLTQGSLMTPGELGVTSSLPAEVKKTGVSMKQVTSGSSREYSDDEDL
DEENETTGSLKPEDVKKSRRMLSNRESARRSRRRKQEQTSDLETQVNDLKGEHSSLLKQLSNMNHKYDE
AAVGNRILKADIETLRAKVKMAEETVKRVTGMNPMLLGRSSGHNNNNRMPITGNNRMDSSSIIPAYQPH
SNLNHMSNQNIGIPTILPPRLGNNFAAPPSQTSSPLQRIRNGQNHHVTPSANPYGWNTEPQNDSAWPKK
CVD

Figure 128.

MGSLQMQTSPESDNDPRYATVTDERKRKRMISNRESARRSRMRKQKQLGDLINEVTLLKNDNAKITEQV
DEASKKYIEMESKNNVLRAQASELTDRLRSLNSVLEMVEEISGQALDIPEIPESMQNPWQMPCPMQPIR
ASADMFDC

Figure 129.

MTSFQVMRSSNSRNSDLSRRISSASTSSSSIRPQQQFRRDLTSVGYGGRNDGLYSSNSMTVEGILHDTF
ASDPPAPTESSLLDASINLMDASPAPMEITTTTASDVVDHGGGTETTRGGKSVDEIWREMVSGEGKGMK
EETSEEIMTLEDFLAKAAVEDETAVTASAEDLDVKIPVTNYGFDHSAPPHNPFQMIDKVEGSIVAFGNG
LDVYGGGARGKRARVMVEPLDKAAAQRQRRMIKNRESAARSRERKQAYQVELEALAAKLEEENELLSKE
IEDKRKERYQKLMEFVIPVVEKPKQQPPRFLRRIRSLEW

Figure 130.

MGSRLNFKSFVDGVSEQQPTVGTSLPLTRQNSVFSLTFDEFQNSWGGGIGKDFGSMNMDELLKNIWTAE
ESHSMMGNNTSYTNISNGNSGNTVINGGGNNIGGLAVGVGGESGGFFTGGSLQRQGSLTLPRTISQKRV
DDVWKELMKEDDIGNGVVNGGTSGIPQRQQTLGEMTLEEFLVRAGVVREEPQPVESVTNFNGGFYGFGS
NGGLGTASNGFVANQPQDLSGNGVAVRQDLLTAQTQPLQMQQPQMVQQPQMVQQPQQLIQTQERPFPKQ
TTIAFSNTVDVVNRSQPATQCQEVKPSILGIHNHPMNNNLLQAVDFKTGVTVAAVSPGSQMSPDLTPKS
ALDASLSPVPYMFGRVRKTGAVLEKVIERRQKRMIKNRESAARSRARKQAYTMELEAEIAQLKELNEEL
QKKQVEIMEKQKNQLLEPLRQPWGMGCKRQCLRRTLTGPW

Figure 131.

MASGREEFVYMAKLAEQAERYEEMVEFMEKVSAAVDGDELTVEERNLLSVAYKNVIGARRASWRIISSI
EQKEESRGNDDHVTAIREYRSKIETELSGICDGILKLLDSRLIPAAASGDSKVFYLKMKGDYHRYLAEF
KTGQERKDAAEHTLAAYKSAQDIANAELAPTHPIRLGLALNFSVFYYEILNSPDRACNLAKQAFDEAIA
ELDTLGEESYKDSTLIMQLLRDNLTLWTSDMQDDAADEIKEAAAPKPTEEQQ

Figure 132.

MATPGASSARDEFVYMAKLAEQAERYEEMVEFMEKVAKAVDKDELTVEERNLLSVAYKNVIGARRASWR
IISSIEQKEESRGNDDHVSLIRDYRSKIETELSDICDGILKLLDTILVPAAASGDSKVFYLKMKGDYHR
YLAEFKSGQERKDAAEHTLTAYKAAQDIANSELAPTHPIRLGLALNFSVFYYEILNSPDRACNLAKQAF
DEAIAELDTLGEESYKDSTLIMQLLRDNLTLWTSDMQDDVADDIKEAAPAAAKPADEQQS

Figure 133.

MAAPPASSSAREEFVYLAKLAEQAERYEEMVEFMEKVAEAVDKDELTVEERNLLSVAYKNVIGARRASW
RIISSIEQKEESRGNDDHVTTIRDYRSKIESELSKICDGILKLLDTRLVPASANGDSKVFYLKMKGDYH
RYLAEFKTGQERKDAAEHTLTAYKAAQDIANAELAPTHPIRLGLALNFSVFYYEILNSPDRACNLAKQA
FDEAIAELDTLGEESYKDSTLIMQLLRDNLTLWTSDMQDESPEEIKEAAAPKPAEEQKEI

Figure 134.

MATTLSRDQYVYMAKLAEQAERYEEMVQFMEQLVSGATPAGELTVEERNLLSVAYKNVIGSLRAAWRIV
SSIEQKEESRKNEEHVSLVKDYRSKVETELSSICSGILRLLDSHLIPSATASESKVFYLKMKGDYHRYL
AEFKSGDERKTAAEDTMIAYKAAQDVAVADLAPTHPIRLGLALNFSVFYYEILNSSEKACSMAKQAFEE
AIAELDTLGEESYKDSTLIMQLLRDNLTLWTSDMQEQMDEA

Figure 135.

MGSGKERDTFVYLAKLSEQAERYEEMVESMKSVAKLNVDLTVEERNLLSVGYKNVIGSRRASWRIFSSI
EQKEAVKGNDVNVKRIKEYMEKVELELSNICIDIMSVLDEHLIPSASEGESTVFFNKMKGDYYRYLAEF
KSGNERKEAADQSLKAYEIATTAAEAKLPPTHPIRLGLALNFSVFYYEIMNAPERACHLAKQAFDEAIS
ELDTLNEESYKDSTLIMQLLRDNLTLWTSDISEEGGDDAHKTNGSAKPGAGGDDAE

Figure 136.

MSSSREENVYLAKLAEQAERYEEMVEFMEKVAKTVDTDELTVEE<u>RNLLSVAYKNV</u>IGARRASWRIISSI
EQKEESRGNDDHVSIIKDYRGKIETELSKICDGILNLLDSHLVPTASLAESKVFYLKMKGDYHRYLAEF
KTGAERKEAAESTLVAYKSAQDIALADLAPTHPIRLGLALNFSVFYYEILNSPDRACSLAKQAFDEAIS
ELDTLGEES<u>YKDSTLIMQLLRDNLTLWNS</u>DINDEAGGDEIKEASKHEPEEGKPAETGQ

Figure 137.

MSSSGSDKERETFVYMAKLSEQAERYDEMVETMKKVARVNSELTVEE<u>RNLLSVGYKNV</u>IGARRASWRIM
SSIEQKEESKGNESNVKQIKGYRQKVEDELANICQDILTIIDQHLIPHATSGEATVFYYKMKGDYYRYL
AEFKTEQERKEAAEQSLKGYEAATQAASTELPSTHPIRLGLALNFSVFYYEIMNSPERACHLAKQAFDE
AIAELDTLSEES<u>YKDSTLIMQLLRDNLTLWTS</u>DLPEDGGEDNIKTEESKQEQAKPADATEN

Figure 138.

MGTGEMGTPAKTTKASTPQEQPPTSTAMLYPDWAAAFQAYYNSGTTPPPPPAYFHSSVASSPQPHPYMW
GGQPLMPPYGTLPPPYAAMYHHGSMYAHPSMPPGAHPFAPYVMTSSLSTTEGAPVGTTSGADAEGKPSE
PKDQTLLKRSKGSLGSLNMLTGKINEADKGTGGGGNGALSISGESGSEGSSERSDETSQNGSEATQKKG
FELNSTKAAEAQNTTTTSYNAHGGSAFGASGVQTVNATVNLAIAAVPISVAGKSATVAGSKTNLNMGMD
YWSGSTTATSTMRGKRPAVPRTTAMVPAPQSISLMVPCDGVPTELWDERELKRQ<u>RRKQSNRESARRSRL</u>
<u>R</u>KQAECEDLAKRVDILKAENASLRKELNRLGEECKKLSTENAFLHKKLCKAPEEETRDTRSEKDGEAGT
GEQHEQQNEDTDSGAVESMQRDGRREETSFNLDGKNQPLDNRNQAVSVSAG

Figure 139.

MSSEKERDAHVYLAKLAEQAERYDEMVECMKKVAKLDLDLTVEE<u>RNLLSVGYKNV</u>IGARRASWRIMSSI
EQKEESKGNEHNVKLVRDYRQKVEEELSKICSDILSIIDKHLIPSSNAGEATVFYYKMKGDYYRYLAEF
KIDQERKEAAEQSLKGYEAASSTANTELPSTHPIRLGLALNFSVFYYEIMNSPERACHLAKQAFDEAIA
ELDTLSEES<u>YKDSTLIMQLLRDNLTLWTS</u>DLPEDGGEDGIKVEEPKPAEPEH

Figure 140.

MASTKERDGYVYVAKLAEQAERYDEMVEAMKNVAKLDVELTVEE<u>RNLLSVGYKNV</u>IGARRASWRILSSI
EQKEDSKGNEHNVKKIKEYRQKVEAELANICGDVMKVIDEHLIPSCAGGESTVFFYKMKGDYYRYLAEF
KAGDDRKEAADQSMKAYELASTTAEADLSPTHPIRLGLALNFSVFYYEIMNSPERACHLAKQAFDEAIS
ELDTLSEES<u>YKDSTLIMQLLRDNLTLWTS</u>DIPEDGAEDAQKLDNAAKAAGGEDAE<u>*GRVLLGSS</u>

Figure 141.

MERYEVLEQIGKGSFGSALLVRHKQERKKYVLKKIRLARQSDRARRSAHQEMELISTVRNPFVVEYKDS
WVEKGCYVCIVIGYCQGGDMTDTIKRACGVHFPEEKLCQWLVQLLMALDYLHSNH|ILHRDVKCSNIFL|T
KEQDIRLGDFGLAKILTSDDLTSSVVGTPSYMCPELLADIPYGSKSDIWSLGCCMYEMAAHKPPFKASD
VQTLITKIHKLIMDPIPAMYSGSFRGLIKSMLRKNPELRPSANELLNHPHLQPYISMVYMKLESPRRST
FPLQFSERDATLKERRRSSFSNDRRLNPSVSDTEAGSVSSSGKASPTPMFNGRKVSEVTVGVVREEIVP
QRQEEAKKQSGAARTPRVAGTSAKASTQRTVFKHELMKVSNPTERRRRVSLPLVVENPYTYESDITALC
SLNSPDVSVNTPRFDKIAEFPEDIFQNQNRETASRREVARHSFSSPPCPPHGEDNSNGSITKDKCTVQK
RSVSEVKQRRFDTSSYQQRAEALEGLLEFSAKLLQQERYDELGVLLKPFGAERVSSRETAIWLTKSFKE
ASV

Figure 142.

MANKISETASKMDDYEVVEQIGRGAFGSAFLVIHKSERRKYVVKKIRLAKQTERCKLAAIQEMSLISKL
KSPYIVEYKDSWVEKDCVCIVTSYCEGGDMTQMIKKSRGVFASEEKLCRWMVQLLLAIDYLHNNR|VLHR|
|DLKCSNIFL|TKENEVRLGDFGLAKLLGKDDLASSMVGTPNYMCPELLADIPYGYKSDIWSLGCCMFEVA
AHQPAFKAPDMAALINKINRSSLSPLPVMYSSSLKRLIKSMLRKNPEHRPTAAELLRHPHLQPYLAQCQ
NLSPVFKPVVSKSEHNTNENRTGLPPKTKSAKTPIKHNQESEETEKKNKDTSSSKDKERPAKSQEMSV
ISTLTLLREFQKKSPKSEERAEALESLLELCAGLLRQEKFDELEGVLKPFGDETVSSRETAIWLTKSLM
NVKRKQNDDETNI

Figure 143.

MENYEVLEQIGKGSFGSALLVRHKHEKKLYVLKKIRLARQTGRTRRSAHQEMELISKIHNPFIVEYKDS
WVEKGCYVCIIIGYCKGGDMAEAIKKTNGVHFTEEKLCKWLVQILLALEYLHANH|ILHRDVKCSNIFL|T
KDQDIRLGDFGLAKVLTSDDLASSVVGTPSYMCPELLADIPYGSKSDIWSLGCCMYEMTAMKPAFKAFD
MQGLINRINRSIVPPLPAQYSAAFRGLVKSMLRKNPELRPSAAELLRQPLLQPYIQKIHLKVNDPGSNV
LPAQWPESESARRNSFPEQRRRPAGKSHSFGPSRFRGNLEDSVSSIKKTVPAYLNRERQVDLSTDASGD
GTVVRRTSEASKSSRYVPVRASASPVRPRQPRSDLGQLPVSSQLKNRKPAALIRRASMPSSRKPAKEIK
DSLYISKTSFLHQINSPDVSMNAPRIDKIEFPLASYEEEPFVPVVRGKKKKASSRGSYSPPPEPPLDCS
ITKDKFTLEPGQNREGAIMKAVYEEDAYLEDRSESSDQNATAGASSRASSGVRRQRFDPSSYQQRAEAL
EGLLEFSARLLQDERYDELNVLLRPFGPGKVSPRETAIWLSKSFKETTTTKLGD

Figure 144.

RFVEPLVVGRVIGDVLHMFVPGVDLAVTYASRQVNNGCELKPSAVALLPRVDIGGEDLRNFYTLVMTDP
DAPSPSDPTLREYLHWIVTDIPATTSASFGRELVSYESPRPTIGIHRFIFVLFKQIGRQTVYPPSSRIN
FNTRNFARSNSLGLPVAAVYFNAQKETAGRRR

Figure 145.

MEYDSGIPMSVTEGHSSALAPSLREDALWQMNLGSGEIMGSGSYPVRPGEPDCSYYIRTGLCRFGATC
RFNHPPNRELAIATARMKGEFPERIGQPECQYYLKTGTCKFGATCKFHHPRDKAGIAGRVALNILGYP
LRPSETECAYYLRTGQCKFGNTCKFHHPQPTNMMVSLRGSPIYPTVQSPTPGQQSYPGGSTNWSRASF
IPSPRWQGPSSYASLILPQGVLSVPGWNAFNDQLGSVSSSESPQQTRENVFPERPGQPECQFYMKTGD
CKFGAVCRFHHPRERVLPAPDCVLSPIGLPLRPGEPLCIFYSRYGICKFGPSCKFDHPMGIFTYNLSA
ASSANAPVQHLFGTSSGTTALNLSSEGLVEAGSAKPRRLSISESREMPSDDENDAEG

Figure 146.

MASEGASSENFTSISREFNALVIAGAEIGDGYRQDRPINEAPNNLSRIGEEDQATPEEETNPLAIVPDG
HPFDDQLTPSSITRQENSSGGGAAATREISLQMVKKEEVETKISAWRNAKIAKINNRFKREDAVISGWE
REQVQKATSWMKKVQRRLEERRAKALEKMENEVAKARRKAEERRASAEAKRGTKVAKVIEISNLMRAVG
RPPAKRSFF

Figure 148A

Figure 151

CONTROL OF FLORAL INDUCTION

CROSS-REFERENCE TO RELATED APPLICATIONS

This application claims priority to U.S. Provisional Patent Application No. 60/498,940, filed Aug. 29, 2003, and U.S. Provisional Patent Application No. 60/509,440, filed Oct. 7, 2003, and U.S. Provisional Patent Application No. 60/587,881, filed Jul. 14, 2004.

REFERENCE TO SEQUENCE LISTING SUBMITTED ON COMPACT DISC

This application incorporates by reference in its entirety the Sequence Listing contained in the accompanying two compact discs, one of which is a duplicate copy. Each CD contains a single file, name "1084Useqlist.txt", the size of which is 1,203 KB, and which was created on Aug. 30, 2004 in IBM-PC MS-Windows format pursuant to 37 CFR §1.52 (e).

FIELD OF THE INVENTION

This application relates to control of systemic signaling processes in plants by phloem-regulatory molecules. In particular, this application is directed to the identification and isolation of phloem regulators of flowering in plants.

BACKGROUND

Flowering is an age (development)-dependent response which occurs following a period of vegetative growth in which the plant acquires the competence to flower. The timing of flowering is highly regulated to ensure effective pollination and that seed maturation occurs under favorable environmental conditions.

The earliest stage of flowering, floral evocation, is characterized by the normally irrevocable commitment of shoot apical meristem (SAM) to form an inflorescence or floral meristem. Floral evocation occurs prior to the appearance of detectable morphological or functional changes in the SAM. Subsequently, the floral primordium differentiates and forms floral organs, the flower matures and opens.

Environmental inputs are also involved in the onset of floral evocation. In certain species of plants, floral evocation will not occur in the absence of an appropriate environmental stimulus (e.g., daylength (photoperiodism), cold temperatures (vernalization) and/or other environmental stresses such as drought), while in other species, floral evocation will occur at a time that is predetermined genetically for that species but is susceptible to modulation by the environment. Genetic studies in *Arabidopsis* have provided information about the organization and integration of flower signaling pathways in this model system in which there exists three flower signaling pathways: an age-dependent, daylength-independent pathway which operates in the absence of promoting signals; an autonomous pathway which suppresses the vegetative-to-flowering transition; and a photoperiodic pathway, which in this species of plant, is triggered when the photoperiod exceeds a critical length (reviewed by Devlin and Kay, *Science* 288: 1600 (2000)).

Flowering control in Arabidosis is normally described as controlled by 4 pathways:

1) Autonomous promotion
2) vernalization promotion
3) gibberellic acid promotion
4) photoperiod promotion Simpson, Gendall and Dean, *Ann. Rev. Cell Dev. Biol.* 99: 519–550, 1999.

An understanding of the flower control mechanisms that operate in agronomically and horticulturally important plants is a prerequisite for being able to control the occurrence, timing and extent of flower and seed production. The ability to override, or change, the genetic programs of flowering plants, to accelerate flowering or to permit flowering under environmental conditions different from those of normal, without altering the fertility of the plants or their desirable traits would be of tremendous importance in agriculture and horticulture. The acceleration of flowering is useful in plant breeding to increase the efficiency and speed of selection of improved traits, and in the ornamental flower industry. The ability to delay flowering is important in certain crop plants in which flowering overlaps with growth of harvested vegetation, such as onions, bulbs, lettuce, cabbage and pastures.

One of the most useful paradigms for studying the control of flowering is the photoperiodic response. In many plant species, mature leaves serve as photoreceptors for photoperiodic induction leading to floral initiation within the vegetative meristem. Although the identity of the transmitted flowering stimulus is presently unknown, grafting and defoliation experiments have provided irrefutable evidence that a flowering stimulus is produced in the leaves of plants exposed to a favorable photoperiod. Upon stimulation, a phloem-mobile agent, termed florigen, appears to be released from leaf cells for translocation and delivery into the terminal phloem cells within the apex of the plant. Relay of the florigenic signal from the phloem to the founder cells within the SAM then gives rise to the activation of a new developmental program that generates floral meristems and, eventually, flowers. Available evidence suggests that flower development in certain species of plants may be controlled by both positive and negative regulatory factors, the latter at times being produced in response to an unfavorable photoperiodic stimulus. See, e.g., Gibby and Salisbury, *Plant Physiol.* 47:784–789 (1971); Lang et al., *Proc. Natl. Acad. Sci. USA* 74:2412–2416 (1977).

Significant progress has been made in identifying structural and regulatory genes involved in pathways of flower development and in understanding the hierarchical controls that integrate multiple pathways. See, e.g., Levy and Dean, *Plant Cell* 10:1973–1989 (1998); Simpson et al., *Annu. Rev. Cell Dev. Biol.* 99:519–50 (1999). Multiple environmental and endogenous signals are integrated by floral integrator genes, which participate in the upregulation of floral meristem identity genes which is required for flowering.

Genetic analysis in *Arabidopsis* has revealed many of the genes involved in photoperiod-mediated flowering. In this pathway, the timing of the floral transition is coordinated with day-length, as sensed by the circadian oscillator. The transition is accelerated in response to long days and retarded in response to short days. CO (CONSTANS), a transcription factor, plays an important regulatory role in this process. The level of CO mRNA is circadian clock-regulated. Under long day length conditions (LD), CO protein accumulates late in the day and directly activates transcription of FT (FLOWERING LOCUS T), a floral integrator gene. The level of CO-activated FT expression in *Arabidopsis* is tightly regulated by TFL2 (TERMINAL FLOWER 2), a gene that is coexpressed with CO and FT in leaf vascular tissue (Takada and Goto, *The Plant Cell* 15, 2856–2865 (2003)).

FT encodes a RAF-kinase-inhibitor-like protein that promotes flowering. The *Arabidopsis* FT polynucleotide and polypeptide sequences and methods of use for accelerating or delaying flowering are disclosed in U.S. Pat. Nos. 6,225,530 and 6,713,663 respectively.

CO also activates LEAFY (LFY), a floral meristem identity gene. FT, together with LFY, promotes flowering. The loss of FT delays flowering, whereas overexpression of FT accelerates flowering by a CO- and photoperiod-independent process.

FT belongs to a gene family which is conserved in plants, mammals and fungi. Two known plant family members are CEN (*Antirrhinum majus*) and TFL1 (*Arabidopsis thaliana*). TFL1 is required for establishing and maintaining the inflorescence meristem. TFL1 and CEN are orthologous genes according to phylogenetic tree analysis of the protein sequences (see U.S. Pat. No. 6,225,530). FT, acting downstream of CO, promotes flowering, whereas TERMINAL FLOWER1 (TFL1) represses flowering.

Flowering promotion by FT requires FD, a bZIP transcription factor-encoding gene. FD is preferentially expressed in the shoot apex and activates transcription of the floral meristem identity genes AP1 and CAL. The overexpression of FD in seedlings upregulates AP1 expression only when FT is present. The interaction of FD with FT may require phosphorylation of the C-terminus of FD. (Daimon et al., Abstract T01–033, 15th International Conference on *Arabidopsis*, Berlin, Germany, Jul. 11–14, 2004).

TFL1 interacts with FDP, a bZIP transcription factor which is closely related to FD. The interaction of FDP and TFL1 may be required to prevent inappropriate activation of flowering by FD and FT in the SAM (Wigge et al., Abstract T01–070, 15th International Conference on *Arabidopsis*, Berlin, Germany, Jul. 11–14, 2004).

Reportedly, both TFL1 and FT protein move from cell to cell in the SAM. (Goto and Nakayama, Abstract T01–053, 15th International Conference on *Arabidopsis*, Berlin, Germany, Jul. 11–14, 2004).

Unpublished studies from our laboratory have shown that ectopic expression of the *Arabidopsis* FT gene in the vasculature of *Cucurbita moschata*, grown under non-flowering photoperiod conditions, promotes flowering in the meristem. We used a viral vector system based on Zucchini yellow mosaic potyvirus (ZYMV) to express FT (ZYMV-FT) in *C. moschata* PI441726. In contrast to control plants inoculated with ZYMV-GFP, plants inoculated with ZYMV-FT formed floral buds and flowered within 23–35 days. These results were obtained in replicate independent experiments with four to six plants per experiment. Representative results are shown below in FIGS. 147 and 148. Our results show that expression of FT in the vasculature sends a signal to the meristem to initiate flowering. Our results are consistent with the possibility that FT or a peptide fragment of FT acts as the signal, as potyviruses are normally excluded from the meristem of plants (Jones et al., *EMBO J.* 17:6385–6393, 1998). However, as discussed in the Detailed Description below, these results are also consistent with the possibility that FT participates in a signaling complex with other interacting molecules and that one of these interacting molecules, or a different gene altogether, comprises the long-distance florigenic signal Coupland and colleagues expressed CO::GUS promoter-reporter gene constructs in *Arabidopsis* and found expression of the reporter gene in both vascular tissue and the SAM. Mis-expression of CO from phloem-specific promoters, but not meristem-specific promoters, induced early flowering and complemented a late-flowering constans mutation. CO activates flowering through both FT-dependent and FT-independent processes (Laurent et al., Abstract T01–048, 15th International Conference on *Arabidopsis*, Berlin, Germany, Jul. 11–14, 2004).

Micrografting experiments in *Arabidopsis* have shown that certain flowering time mutants can be rescued by long-distance signaling, and suggest that the expression of FT in the apex and leaf may be required (Turnbull and Justin, Abstract T01–099, 15th International Conference on *Arabidopsis*, Berlin, Germany, Jul. 11–14, 2004).

The CEN, TFL1, FT and SP (SELF-PRUNING) genes are a closely related set of plant genes which are implicated as regulators of timing of switching of meristems from vegetative to reproductive growth (all except FT delay flowering) (Bradley et al., *Science* 275:80–83 (1997); Bradley et al., *Nature* 379:791–797 (1996); Pneuli et al., *Development* 125:1979–1989 (1998); Pneuli et al., *The Plant Cell*, 13:2687–2702 (2001). This gene family, recently named CETS (Pneuli et al., Ibid)), is comprised of plant homologs of the mammalian phosphatidylethanolamine binding proteins (PEBPs), which include serine protease inhibitors, Raf-1 kinase inhibitor (RKIP), and precursor for hippocampal neurostimulatory peptide (HCNP). Six CETS members have been identified in *Arabidopsis* and six in tomato.

Two-hybrid screens and in vitro binding assays have revealed the presence of SP-interacting proteins (SIPS) in tomato (Pneuli et al., 2001). These SIPs include: SPAK, a novel plant serine-threonine NIMA-like kinase; several isoforms of the 14-3-3 family of adapter proteins; and SPGB, a putative bZIP G-box binding transcription factor C-terminal sequence similarity to GBF4.

SIPs may function as components of an SP-dependent signaling network in tomato plants. SIPs form specific associations with one another and show overlapping spatio-temporal expression patterns in apical meristem, leaf and stem vasculature, floral primordial of the primary inflorescence, stamens and carpels in developing floral bud and vegetative meristem of the first sympodial segment (Pneuli et al., 2001, *Ibid*). Several of the binding interactions are phosphorylation-dependent. For example, the binding of SP to SPAK and the binding of SIP4 and SPAK to 14-3-3/74 requires phosphorylation of SPAK at Serine 406. Both CEN and TFL1 bind SPAK, 14-3-3/74 and SPGB proteins but not SIP4 (a novel 10 kDa protein). FT showed the same binding pattern as TFL1.

The biological functions of SP/14-3-3/SPAK interactions in tomato plants are not yet understood. Nevertheless, the finding that CETS proteins of *Arabidopsis* and *Antirrhinum* form specific complexes with tomato SIPs suggests that protein-protein interactions may be necessary for CETS protein function in plants with widely differing shoot and flowering architecture.

PCT Application No. WO 96/34088 discloses the isolation of the Id gene, which is thought to be important in regulating the transition to flowering in maize. The Id gene encodes a zinc-finger protein that is apparently transcribed in young leaves but not in the shoot apical meristem. The mechanism by which this gene produces its effects at the SAM has not yet been elucidated. Mutated forms of the gene are proposed for use in accelerating or delaying floral induction in a plant. PCT Application No. WO 97/25433 describes chimeric vectors comprising FPF (flowering promoting factor) genes from mustard, and homologous genes from other plants, and uses thereof for inducing early flowering or inhibiting flowering in various crop plants.

Progress has also been made in understanding how plants transport materials from cell-to-cell and systemically throughout the plant. These studies have provided evidence for a systemic communication network that comprises a phloem translocation system which is capable of transporting not only small phytohormones and nutrients but also macromolecules (such as peptides, proteins and nucleic acids) between spatially distant tissues and organs of the plant. The identification of specific transcripts and signaling molecules in phloem sap suggests that this communication network is involved in the coordination of growth and development, and may participate in systemic acquired resistance to pathogens (Narvaez-Vasquez et al., *Planta* 195:593–600 (1995), systemic gene silencing (Jorgensen et al., *Science* 279:1486–1487 (1988), review), biomass distribution, regulation of carbon metabolism and control of plant size (Lucas, PCT applications WO 97/06669 and WO 97/20470), and floral development (Ruiz-Medrano et al., *Development* 126:4405–4419 (1999) and references cited therein; Baulcombe, PCT application WO 99/15682). A systemic small RNA binding protein which may function in sRNA signaling has been isolated from several plant species and is disclosed in U.S. Application Ser. No. 60/487,358.

The broad outlines of florigen signaling have emerged from these and prior studies, but the signal(s) that initiate floral evocation and the manner in which the long-distance florigen signaling pathway is regulated are presently unknown. These objectives are addressed in the present application.

SUMMARY OF THE INVENTION

The present invention provides methods for (1) identifying the long-distance florigenic signaling component and/or signaling complex (LDFSC) and other genes in the florigenic signaling cascade; (2) modifying the occurrence, timing and extent of flower development by modulating the florigenic signaling pathway; and (3) screening for inducers, repressors and modulators of florigenic signaling. The invention further provides isolated polynucleotide sequences from plant species that encode putative regulators of long-distance florigenic signaling. These polynucleotide sequences are identified in the Sequence Listing as SEQ ID NOs: 1–25, 119–151, 271–298, 377–380, 561–638 (cucurbits); SEQ ID NOs: 51–75, 185–217 and 299–322, 405–482 (*Arabidopsis* orthologs), SEQ ID NO: 323 (*Pinus radiata* ortholog), and SEQ ID NOs: 717–794 (*Festuca arundinacea*). Their encoded polypeptide sequences are identified respectively as SEQ ID NOs. 26–50, 152–184, 324–351, 381, 382, 639–716 (cucurbits); SEQ ID NOs. 76–100, 218–250, 352–375, and 483–560 (*Arabidopsis* orthologs), SEQ ID NO: 376 (*Pinus radiata* ortholog); and SEQ ID NOs: 795–872 (*Festuca arundinacea*).

SEQ ID NOs. 132 and 165 are respectively the polynucleotide and encoded polypeptide sequence of *C. maxima* FT; SEQ ID NOs: 198 and 231 are respectively the polynucleotide and encoded polypeptide sequence of *A. thaliana* FT, and SEQ ID NOs: 323 and 376 are respectively the polynucleotide and encoded polypeptide sequence of *P. radiata* FT.

Polynucleotide sequences with SEQ ID NOs. 271–322 encode regulatory molecules which include putative orthologs of SIPs described in Pneuli et al., *The Plant Cell*, 13, 2687–2702 (2001).

Putative sRNA phloem mobile regulators of flowering have been identified in Cucurbit phloem sap databases. These sequences are identified in the Sequence Listing as SEQ ID NOs. 251–263. The invention encompasses genetic constructs comprising these polynucleotides and plants comprising the constructs that display modified flowering responses as compared with unmodified native plants.

BRIEF DESCRIPTION OF THE FIGURES

FIG. 1. Schematic to illustrate aspects of florigen signaling pathway.

FIG. 2. Amino acid sequence of SEQ ID NO: 26. The conserved Myb2 domain is underlined and conserved SHAQKYF domain is in bold (Rose et al., *Plant J.* 20:641–652, 1999).

FIG. 3. Amino acid sequence of SEQ ID NO: 27. The conserved RNA-binding region RNP-1 (RNA recognition motif) is in bold/italics and the C-x8-C-x5-C-x3-H type zinc finger is underlined with the conserved Cys and His residues boxed (Deng et al., *Cell* 71:791–801, 1992).

FIG. 4. Amino acid sequence of SEQ ID NO: 28. The conserved response regulator receiver domain is underlined.

FIG. 5. Amino acid sequence of SEQ ID NO: 30. The conserved C-x8-C-x5-C-x3-H type zinc finger is underlined with the conserved Cys and His residues boxed (Deng et al., *Cell* 71:791–801, 1992).

FIG. 6. Amino acid sequence of SEQ ID NO: 31. The conserved pathogenesis-related transcriptional factor and ERF domain is underlined.

FIG. 7. Amino acid sequence of SEQ ID NO: 32. The conserved No apical meristem (NAM) protein domain is underlined.

FIG. 8. Amino acid sequence of SEQ ID NO: 33. The conserved basic-leucine zipper (bZIP) transcription factor domain is underlined with the basic-leucine zipper (bZIP) domain signature boxed. Hydrophobic residues that constitute a leucine zipper are in bold (Hobo et al., *Proc. Natl. Acad. Sci. USA* 96:15348–15353, 1999).

FIG. 9. Amino acid sequence of SEQ ID NO: 34. The conserved C-x8-C-x5-C-x3-H type zinc finger is underlined with the conserved Cys and His residues boxed (Deng et al., *Cell* 71:791–801, 1992), and the conserved ankyrin domain is in bold/italics.

FIG. 10. Amino acid sequence of SEQ ID NO: 35. The conserved Pathogenesis-related transcriptional factor and ERF domain is underlined.

FIG. 11. Amino acid sequence of SEQ ID NO: 36. The conserved AUX/IAA protein domain is underlined.

FIG. 12. Amino acid sequence of SEQ ID NO: 37. The conserved AUX/IAA protein domain is underlined.

FIG. 13. Amino acid sequence of SEQ ID NO: 38. The conserved response regulator receiver domain is underlined.

FIG. 14. Amino acid sequence of SEQ ID NO: 39. The conserved HSF-type DNA-binding domain is underlined with the HSF-type DNA-binding domain signature boxed.

FIG. 15. Amino acid sequence of SEQ ID NO: 40. The conserved WRKY domain is underlined and contains the highly conserved WRKYGQK motif (boxed; Eulgem et al., *EMBO J.* 18:4689–4699, 1999) and a conserved C2H2 zinc finger of the WRKY Group II. The conserved cysteine and histidine residues of the zinc finger are double-underlined and in bold (Eulgem et al., *Trends Plant Sci.* 5:199–206, 2000).

FIG. 16. Amino acid sequence of SEQ ID NO: 41. The conserved basic-leucine zipper (bZIP) transcription factor domain is underlined and the hydrophobic residues that constitute a leucine zipper are boxed (Hobo et al., *Proc. Natl. Acad. Sci. USA* 96:15348–15353, 1999).

FIG. 17. Amino acid sequence of SEQ ID NO: 42. The conserved basic-leucine zipper (bZIP) transcription factor domain is underlined and the hydrophobic residues that constitute a leucine zipper are boxed (Hobo et al., *Proc. Natl. Acad. Sci. USA* 96:15348–15353, 1999).

FIG. 18. Amino acid sequence of SEQ ID NO: 43. The conserved jumonji transcription factor, jmjC domain is underlined.

FIG. 19. Amino acid sequence of SEQ ID NO: 44. The conserved jumonji transcription factor, jmjC domain is underlined.

FIG. 20. Amino acid sequence of SEQ ID NO: 46. The conserved No apical meristem (NAM) protein domain is underlined.

FIG. 21. Amino acid sequence of SEQ ID NO: 47. The conserved pathogenesis-related transcriptional factor and ERF domain is underlined.

FIG. 22. Amino acid sequence of SEQ ID NO: 48. The conserved C2H2 type Zn-finger is underlined with the conserved Cys and His residues boxed (Kubo et al., *Nucleic Acids Res.* 26:608–615, 1998).

FIG. 23. Amino acid sequence of SEQ ID NO: 49. The conserved No apical meristem (NAM) protein domain is underlined.

FIG. 24. Amino acid sequence of SEQ ID NO: 50. The conserved WRKY domain is underlined and contains the highly conserved WRKYGQK motif (boxed; Eulgem et al., *EMBO J.* 18:4689–4699, 1999) and a conserved C2H2 zinc finger of the WRKY Group II with the conserved cysteine and histidine residues double-underlined and in bold (Eulgem et al., *Trends Plant Sci.* 5:199–206, 2000).

FIG. 25. Amino acid sequence of SEQ ID NO: 76, encoding a Myb transcription factor. The conserved Myb2 domain is underlined and conserved SHAQKYF domain is in bold (Rose et al., *Plant J.* 20:641–652, 1999).

FIG. 26. Amino acid sequence of SEQ ID NO: 77. The conserved RNA-binding region RNP-1 (RNA recognition motif) is in bold/italics and the C-x8-C-x5-C-x3-H type zinc finger is underlined with the conserved Cys and His residues boxed (Deng et al., *Cell* 71:791–801, 1992).

FIG. 27. Amino acid sequence of SEQ ID NO: 78. The conserved response regulator receiver domain is underlined.

FIG. 28. Amino acid sequence of SEQ ID NO: 80, encoding a zinc finger transcription factor. Conserved C-x8-C-x5-C-x3-H type zinc fingers are underlined with the conserved Cys and His residues boxed (Deng et al., *Cell* 71:791–801, 1992).

FIG. 29. Amino acid sequence of SEQ ID NO: 81, encoding an AP2 domain transcription factor. The conserved pathogenesis-related transcriptional factor and ERF domain is underlined.

FIG. 30. Amino acid sequence of SEQ ID NO: 82, encoding a NAM/CUC2-like protein transcription factor. The conserved No Apical Meristem (NAM) protein domain is underlined.

FIG. 31. Amino acid sequence of SEQ ID NO: 83, encoding a bZIP protein. The conserved basic-leucine zipper (bZIP) transcription factor domain is underlined with the basic-leucine zipper (bZIP) domain signature boxed. Hydrophobic residues that constitute a leucine zipper are in bold (Hobo et al., *Proc. Natl. Acad. Sci. USA* 96:15348–15353, 1999).

FIG. 32. Amino acid sequence of SEQ ID NO: 84, encoding a Cys-3-His zinc finger protein. Conserved C-x8-C-x5-C-x3-H type zinc fingers are underlined with the conserved Cys and His residues boxed (Deng et al., *Cell* 71:791–801, 1992).

FIG. 33. Amino acid sequence of SEQ ID NO: 85, encoding a ethylene responsive element binding factor 4. The conserved pathogenesis-related transcriptional factor and ERF domain is underlined.

FIG. 34. Amino acid sequence of SEQ ID NO: 86, encoding auxin response factor 9. The conserved AUX/IAA protein domain is underlined and the transcriptional factor B3 domain is in bold/italics.

FIG. 35. Amino acid sequence of SEQ ID NO: 87, encoding an Aux/IAA protein. The conserved AUX/IAA protein domain is underlined.

FIG. 36. Amino acid sequence of SEQ ID NO: 88, encoding an ARR2 protein. The conserved response regulator receiver domain is underlined.

FIG. 37. Amino acid sequence of SEQ ID NO: 89, encoding a heat shock transcription factor. The conserved HSF-type DNA-binding domain is underlined with the HSF-type DNA-binding domain signature boxed.

FIG. 38. Amino acid sequence of SEQ ID NO: 90, encoding a WRKY transcription factor. The conserved WRKY domains are underlined and contain the highly conserved WRKYGQK motif (boxed; Eulgem et al., *EMBO J.* 18:4689–4699, 1999) and the two conserved C2H2 zinc fingers of the WRKY Group I. The conserved cysteine and histidine residues double-underlined and in bold (Eulgem et al., *Trends Plant Sci.* 5:199–206, 2000).

FIG. 39. Amino acid sequence of SEQ ID NO: 91. The conserved basic-leucine zipper (bZIP) transcription factor domain is underlined with the basic-leucine zipper (bZIP) domain signature boxed. Hydrophobic residues that constitute a leucine zipper are in bold (Hobo et al., *Proc. Natl. Acad. Sci. USA* 96:15348–15353, 1999).

FIG. 40. Amino acid sequence of SEQ ID NO: 92. The conserved basic-leucine zipper (bZIP) transcription factor domain is underlined with the basic-leucine zipper (bZIP) domain signature boxed. Hydrophobic residues that constitute a leucine zipper are in bold (Hobo et al., *Proc. Natl. Acad. Sci. USA* 96:15348–15353, 1999).

FIG. 41. Amino acid sequence of SEQ ID NO: 93. The conserved jumonji transcription factor jmjN and jmjC domains are underlined. N-and C-terminal FY-rich domains are in bold/italics and a C5HC2 type zinc finger is double underlined with conserved Cys and His residues in bold and boxed (Clissold and Ponting, *Trends Biol. Sci.* 26:7–9, 2001).

FIG. 42. Amino acid sequence of SEQ ID NO: 94. The conserved jumonji transcription factor, jmjC domain is underlined.

FIG. 43. Amino acid sequence of SEQ ID NO: 95. The conserved jumonji transcription factor, jmjC domain is underlined.

FIG. 44. Amino acid sequence of SEQ ID NO: 96, encoding a NAM transcription factor. The conserved No Apical Meristem (NAM) protein domain is underlined.

FIG. 45. Amino acid sequence of SEQ ID NO: 97. The conserved pathogenesis-related transcriptional factor and ERF domain is underlined.

FIG. 46. Amino acid sequence of SEQ ID NO: 98, encoding a zinc finger protein. The conserved C2H2 type Zn-fingers are underlined with the conserved residues boxed (Kubo et al., *Nucleic Acids Res.* 26:608–615, 1998).

FIG. 47. Amino acid sequence of SEQ ID NO: 99, encoding a NAM-like transcription factor. The conserved No Apical Meristem (NAM) protein domain is underlined.

FIG. 48. Amino acid sequence of SEQ ID NO: 100, encoding a WRKY-like transcription factor. The conserved WRKY domain is underlined and contains the highly conserved WRKYGQK motif (boxed; Eulgem et al., *EMBO J.* 18:4689–4699, 1999) and a conserved C2H2 zinc finger of the WRKY Group II with the conserved cysteine and histidine residues double-underlined and in bold (Eulgem et al., *Trends Plant Sci.* 5:199–206, 2000).

FIG. 51. Amino acid sequence of SEQ ID NO: 152. The conserved Histone-fold/TFIID-TAF/NF-Y domain is underlined and the conserved Histone 4 signature is boxed.

FIG. 52. Amino acid sequence of SEQ ID NO: 153. The conserved DEAD/DEAH helicase box is underlined.

FIG. 53. Amino acid sequence of SEQ ID NO: 156. The conserved zinc finger RING-type signature is underlined.

FIG. 54. Amino acid sequence of SEQ ID NO: 157. The conserved Myb DNA-binding domain repeat signature 2 is underlined.

FIG. 55. Amino acid sequence of SEQ ID NO: 159. The conserved Nuclear protein G9a domain is underlined and the Nuclear protein Zn2+-binding domain is in bold/italics.

FIG. 56. Amino acid sequence of SEQ ID NO: 162. The conserved Histone 3 domain is underlined and the Histone H3 signature 2 is boxed.

FIG. 57. Amino acid sequence of SEQ ID NO: 163. The conserved N-terminal and central AAA ATPase domains are underlined. The AAA-protein family signature is boxed.

FIG. 58. Amino acid sequence of SEQ ID NO: 165. The conserved phosphatidylethanolamine-binding protein is underlined and the phosphatidylethanolamine-binding protein family signature is boxed.

FIG. 59. Amino acid sequence of SEQ ID NO: 167. The conserved Ribonuclease III family is underlined and the Ribonuclease III family signature is boxed.

FIG. 60. Amino acid sequence of SEQ ID NO: 170. The conserved nuclear protein SET domain is underlined.

FIG. 61. Amino acid sequence of SEQ ID NO: 171. The conserved helicase C-terminal domain is underlined.

FIG. 62. Amino acid sequence of SEQ ID NO: 173. The conserved Histone-fold/TFIID-TAF/NF-Y Domain is underlined.

FIG. 63. Amino acid sequence of SEQ ID NO: 175. The conserved Glycoside Hydrolase domain is underlined.

FIG. 64. Amino acid sequence of SEQ ID NO: 177. The conserved G-protein beta WD-40 repeats are underlined.

FIG. 65. Amino acid sequence of SEQ ID NO: 178. The conserved TPR repeat regions are underlined.

FIG. 66. Amino acid sequence of SEQ ID NO: 181. The conserved nuclear protein G9a domain is underlined.

FIG. 67. Amino acid sequence of SEQ ID NO: 182. The conserved histone deacetylase family domain is underlined.

FIG. 68. Amino acid sequence of SEQ ID NO: 183. The conserved MADS-box transcription factor domain is underlined and the MADS-box domain signature 1 is boxed.

FIG. 69. Amino acid sequence of SEQ ID NO: 218. The conserved Histone-fold/TFIID-TAF/NF-Y domain is underlined.

FIG. 70. Amino acid sequence of SEQ ID NO: 219. The conserved helicase DEAD/DEAH box is underlined and the C-terminal helicase domain is in bold/italics.

FIG. 71. Amino acid sequence of SEQ ID NO: 222. The conserved SNF2 related domain is underlined, the helicase DEAD/DEAH box and the C-terminal domain are in bold/italics and the RING Zn-finger domain is boxed with the conserved Cys and His residues in bold.

FIG. 72. Amino acid sequence of SEQ ID NO: 225. The conserved nuclear protein SET is underlined, the nuclear protein G9a domain is in bold/italics and the nuclear protein Zn2+-binding domain is double-underlined.

FIG. 73. Amino acid sequence of SEQ ID NO: 226. A conserved TAZ finger is underlined, and conserved ZZ-type zinc fingers are boxed with Cys and His residues characteristic of the ZZ-type zinc fingers in bold and double underlined (Ponting et al., *Trends Biochem. Sci.* 21:11–13, 1996; Puls et al., *Proc. Natl. Acad. Sci. USA* 94:6191–6196, 1997).

FIG. 74. Amino acid sequence of SEQ ID NO: 227. The conserved RNA-binding region RNP-1 (RNA recognition motif) domains are underlined.

FIG. 75. Amino acid sequence of SEQ ID NO: 228. The conserved Histone-fold/TFIID-TAF/NF-Y domain is underlined and the histone H3 signature 2 is boxed.

FIG. 76. Amino acid sequence of SEQ ID NO: 229. A conserved AAA ATPase domain is underlined with the AAA-protein family signature boxed. A conserved bromodomain is in bold/italics.

FIG. 77. Amino acid sequence of SEQ ID NO: 230. The conserved domain for the GRAS family of transcription factors is underlined.

FIG. 78. Amino acid sequence of SEQ ID NO: 231. The conserved phosphatidylethanolamine-binding protein domain is underlined and the phosphatidylethanolamine-binding protein family signature is boxed.

FIG. 79. Amino acid sequence of SEQ ID NO: 222. The conserved RNA-directed DNA polymerase (Reverse transcriptase) domain is underlined, the integrase catalytic domain is in bold/italics and the retrotransposon gag protein is double underlined.

FIG. 80. Amino acid sequence of SEQ ID NO: 233. The conserved Ribonuclease III family domains are underlined, with the Ribonuclease III family signature boxed. The helicase DEAD/DEAH box and C-terminal domains are in bold/italics.

FIG. 81. Amino acid sequence of SEQ ID NO: 234. The conserved SNF2 related domain is underlined, two chromo domains are double-underlined, the helicase DEAD/DEAH box and C-terminal domain are in bold/italics and the PHD finger Zn-finger-like domain is boxed.

FIG. 82. Amino acid sequence of SEQ ID NO: 235. The conserved bromodomain is underlined.

FIG. 83. Amino acid sequence of SEQ ID NO: 236. The conserved nuclear protein SET is underlined, the nuclear protein G9a domain is in bold/italics and the nuclear protein Zn2+-binding domain is double-underlined.

FIG. 84. Amino acid sequence of SEQ ID NO: 237. The conserved SNF2 related domain is underlined and the helicase DEAD/DEAH box and C-terminal domains are in bold/italics.

FIG. 85. Amino acid sequence of SEQ ID NO: 238. The conserved RNA-directed DNA polymerase (Reverse transcriptase) domain is underlined, the integrase catalytic domain is in bold/italics and the retrotransposon gag protein is double underlined.

FIG. 86. Amino acid sequence of SEQ ID NO: 239. The conserved Histone-fold/TFIID-TAF/NF-Y domain is underlined.

FIG. 87. Amino acid sequence of SEQ ID NO: 240. The conserved Methyl-CpG Binding domain is in bold/italics and the PHD Zn-finger-like domains are underlined with the conserved residues in bold.

FIG. 88. Amino acid sequence of SEQ ID NO: 241. The conserved glycoside hydrolase, clan GH-D domain is boxed and the glycoside hydrolase domain is underlined.

FIG. 89. Amino acid sequence of SEQ ID NO: 242. The conserved SNF2 related domain is underlined and the helicase DEAD/DEAH box and the C-terminal domain are in bold/italics.

FIG. 90. Amino acid sequence of SEQ ID NO: 243. The conserved bromodomain is in bold/italics, and the G-protein beta WD-40 repeats are underlined.

FIG. 91. Amino acid sequence of SEQ ID NO: 244. The conserved TPR repeats are underlined.

FIG. 92. Amino acid sequence of SEQ ID NO: 246. The conserved SNF2 related domain is underlined, the helicase DEAD/DEAH box and the C-terminal domain are in bold/italics and the RING Zn-finger domain is boxed with the conserved Cys and His residues in bold.

FIG. 93. Amino acid sequence of SEQ ID NO: 247. The conserved nuclear protein SET is underlined, the nuclear protein G9a domain is in bold/italics and the nuclear protein Zn2+-binding domain is double-underlined.

FIG. 94. Amino acid sequence of SEQ ID NO: 248. The conserved histone deacetylase family domain is underlined.

FIG. 95. Amino acid sequence of SEQ ID NO: 249. The conserved MADS-box domain is underlined and the transcription factor K-box is double-underlined.

FIG. 96. The amino acid sequence of SEQ ID NO: 324. The conserved protein kinase family domain is underlined and the serine/threonine protein kinase active domain is boxed.

FIG. 97. The amino acid sequence of SEQ ID NO: 325. The conserved serine/threonine protein kinase domain is underline and the serine/threonine protein kinase active domain is boxed.

FIG. 98. The amino acid sequence of SEQ ID NO: 326. The conserved basic-leucine zipper (bZIP) transcription factor domain is underlined and the basic-leucine zipper (bZIP) domain signature is boxed.

FIG. 99. The amino acid sequence of SEQ ID NO: 328. The conserved basic-leucine zipper (bZIP) transcription factor domain is underlined and the basic-leucine zipper (bZIP) domain signature is boxed.

FIG. 100. The amino acid sequence of SEQ ID NO: 330. The conserved basic-leucine zipper (bZIP) transcription factor domain is underlined and the basic-leucine zipper (bZIP) domain signature is boxed.

FIG. 101. The amino acid sequence of SEQ ID NO: 331. The conserved basic-leucine zipper (bZIP) transcription factor domain is underlined and the basic-leucine zipper (bZIP) domain signature is boxed.

FIG. 102. The amino acid sequence of SEQ ID NO: 332. The conserved basic-leucine zipper (bZIP) transcription factor domain is underlined and the basic-leucine zipper (bZIP) domain signature is boxed.

FIG. 103. The amino acid sequence of SEQ ID NO: 333. The conserved basic-leucine zipper (bZIP) transcription factor domain is underlined and the basic-leucine zipper (bZIP) domain signature is boxed.

FIG. 104. The amino acid sequence of SEQ ID NO: 334. The conserved basic-leucine zipper (bZIP) transcription factor domain is underlined and the basic-leucine zipper (bZIP) domain signature is boxed.

FIG. 105. The amino acid sequence of SEQ ID NO: 336. The conserved basic-leucine zipper (bZIP) transcription factor domain is underlined and the basic-leucine zipper (bZIP) domain signature is boxed.

FIG. 106. The amino acid sequence of SEQ ID NO: 337. The conserved basic-leucine zipper (bZIP) transcription factor domain is underlined and the basic-leucine zipper (bZIP) domain signature is boxed.

FIG. 107. The amino acid sequence of SEQ ID NO: 338. The conserved 14-3-3 family domain is underlined and the 14-3-3 proteins signatures 1 and 2 are boxed.

FIG. 108. The amino acid sequence of SEQ ID NO: 339. The conserved 14-3-3 family domain is underlined and the 14-3-3 proteins signatures 1 and 2 are boxed.

FIG. 109. The amino acid sequence of SEQ ID NO: 340. The conserved 14-3-3 family domain is underlined and the 14-3-3 proteins signatures 1 and 2 are boxed.

FIG. 110. The amino acid sequence of SEQ ID NO: 341. The conserved 14-3-3 family domain is underlined and the 14-3-3 proteins signature 1 is boxed.

FIG. 111. The amino acid sequence of SEQ ID NO: 342. The conserved 14-3-3 family domain is underlined and the 14-3-3 proteins signature 1 is boxed.

FIG. 112. The amino acid sequence of SEQ ID NO: 343. The conserved 14-3-3 family domain is underlined and the 14-3-3 proteins signatures 1 and 2 are boxed.

FIG. 113. The amino acid sequence of SEQ ID NO: 344. The conserved 14-3-3 family domain is underlined and the 14-3-3 proteins signature 1 is boxed.

FIG. 114. The amino acid sequence of SEQ ID NO: 345. The conserved 14-3-3 family domain is underlined and the 14-3-3 proteins signatures 1 and 2 are boxed.

FIG. 115. The amino acid sequence of SEQ ID NO: 346. The conserved 14-3-3 family domain is underlined and the 14-3-3 proteins signature 1 is boxed.

FIG. 116. The amino acid sequence of SEQ ID NO: 347. The conserved 14-3-3 family domain is underlined and the 14-3-3 proteins signatures 1 and 2 are boxed.

FIG. 117. The amino acid sequence of SEQ ID NO: 348. The conserved 14-3-3 family domain is underlined and the 14-3-3 proteins signatures 1 and 2 are boxed.

FIG. 118. The amino acid sequence of SEQ ID NO: 349. The conserved 14-3-3 family domain is underlined and the 14-3-3 proteins signatures 1 and 2 are boxed.

FIG. 119. The amino acid sequence of SEQ ID NO: 350. The conserved 14-3-3 family domain is underlined and the 14-3-3 proteins signature 1 is boxed.

Figure 49:
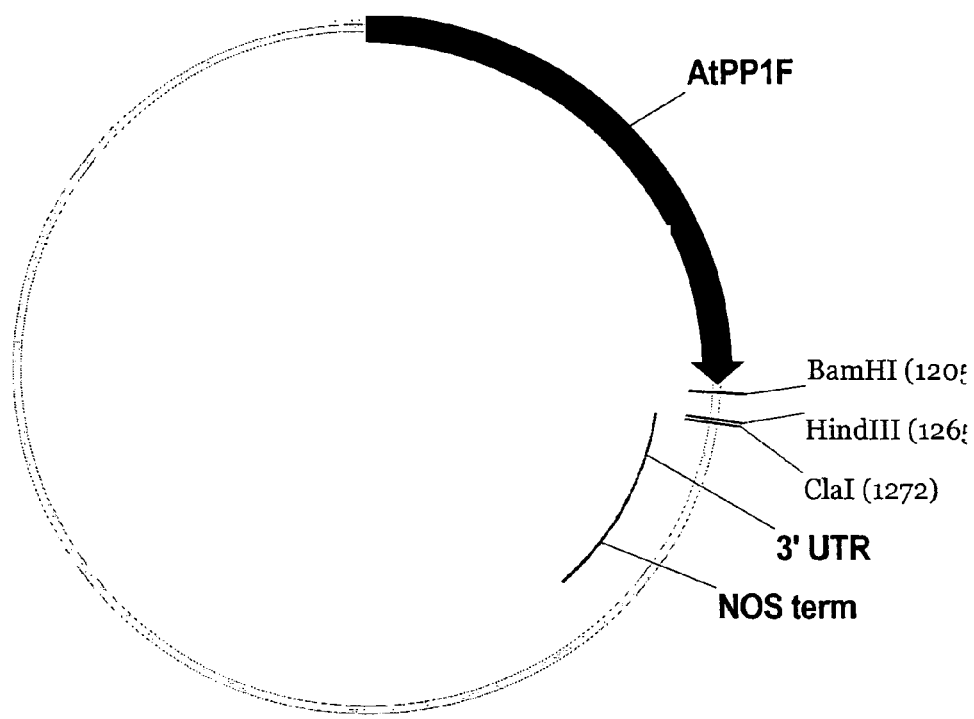
FIG. 49. Exemplary vector containing the *Arabidopsis* PP1 companion cell specific promoter and NOS terminator.

FIG. 120. The amino acid sequence of SEQ ID NO: 351. The conserved 14-3-3 family domain is underlined and the 14-3-3 proteins signature 1 is boxed.

FIG. 121. The amino acid sequence of SEQ ID NO: 352. The conserved protein kinase family domain is underlined and the serine/threonine protein kinase active domain is boxed.

FIG. 122. The amino acid sequence of SEQ ID NO: 353. The conserved protein kinase family domain is underlined and the serine/threonine protein kinase active domain is boxed.

FIG. 123. The amino acid sequence of SEQ ID NO: 355. The conserved basic-leucine zipper (bZIP) transcription factor domain is underlined and the basic-leucine zipper (bZIP) domain signature is boxed.

FIG. 124. The amino acid sequence of SEQ ID NO: 356. The conserved basic-leucine zipper (bZIP) transcription factor domain is underlined and the basic-leucine zipper (bZIP) domain signature is boxed.

FIG. 125. The amino acid sequence of SEQ ID NO: 357. The conserved basic-leucine zipper (bZIP) transcription factor domain is underlined and the basic-leucine zipper (bZIP) domain signature is boxed.

FIG. 126. The amino acid sequence of SEQ ID NO: 358. The conserved basic-leucine zipper (bZIP) transcription factor domain is underlined and the basic-leucine zipper (bZIP) domain signature is boxed.

FIG. 127. The amino acid sequence of SEQ ID NO: 359. The conserved basic-leucine zipper (bZIP) transcription factor domain is underlined and the basic-leucine zipper (bZIP) domain signature is boxed.

FIG. 128. The amino acid sequence of SEQ ID NO: 360. The conserved basic-leucine zipper (bZIP) transcription factor domain is underlined and the basic-leucine zipper (bZIP) domain signature is boxed.

FIG. 129. The amino acid sequence of SEQ ID NO: 361. The conserved basic-leucine zipper (bZIP) transcription factor domain is underlined and the basic-leucine zipper (bZIP) domain signature is boxed.

FIG. 130. The amino acid sequence of SEQ ID NO: 362. The conserved basic-leucine zipper (bZIP) transcription factor domain is underlined and the basic-leucine zipper (bZIP) domain signature is boxed.

FIG. 131. The amino acid sequence of SEQ ID NO: 363. The conserved 14-3-3 family domain is underlined and the 14-3-3 proteins signature 1 is boxed.

FIG. 132. The amino acid sequence of SEQ ID NO: 364. The conserved 14-3-3 family domain is underlined and the 14-3-3 proteins signature 1 is boxed.

FIG. 133. The amino acid sequence of SEQ ID NO: 365. The conserved 14-3-3 family domain is underlined and the 14-3-3 proteins signature 1 is boxed.

FIG. 134. The amino acid sequence of SEQ ID NO: 366. The conserved 14-3-3 family domain is underlined and the 14-3-3 proteins signature 1 is boxed.

FIG. 135. The amino acid sequence of SEQ ID NO: 367. The conserved 14-3-3 family domain is underlined and the 14-3-3 proteins signature 1 is boxed.

FIG. 136. The amino acid sequence of SEQ ID NO: 368. The conserved 14-3-3 family domain is underlined and the 14-3-3 proteins signature 1 is boxed.

FIG. 137. The amino acid sequence of SEQ ID NO: 369. The conserved 14-3-3 family domain is underlined and the 14-3-3 proteins signature 1 is boxed.

FIG. 138. The amino acid sequence of SEQ ID NO: 370. The conserved basic-leucine zipper (bZIP) transcription factor domain is underlined and the basic-leucine zipper (bZIP) domain signature is boxed.

FIG. 139. The amino acid sequence of SEQ ID NO: 371. The conserved 14-3-3 family domain is underlined and the 14-3-3 proteins signature 1 is boxed.

FIG. 140. The amino acid sequence of SEQ ID NO: 372. The conserved 14-3-3 family domain is underlined and the 14-3-3 proteins signature 1 is boxed.

FIG. 141. The amino acid sequence of SEQ ID NO: 373. The conserved protein kinase family domain is underlined and the serine/threonine protein kinase active domain is boxed.

FIG. 142. The amino acid sequence of SEQ ID NO: 374. The conserved protein kinase family domain is underlined and the serine/threonine protein kinase active domain is boxed.

FIG. 143. The amino acid sequence of SEQ ID NO: 375. The conserved protein kinase family domain is underlined and the serine/threonine protein kinase active domain is boxed.

FIG. 144. The amino acid sequence of SEQ ID NO: 376. The conserved phosphatidylethanolamine-binding protein family domain is underlined.

FIG. 145. The amino acid sequence of SEQ ID NO: 381. The conserved C-x8-C-x5-C-x3-H type Zn-finger domains are underlined and the conserved cysteine and histidine residues are boxed.

FIG. 146. The amino acid sequence of SEQ ID NO: 382. The conserved C-terminus of the remorin family domain is underlined.

Figure 147:
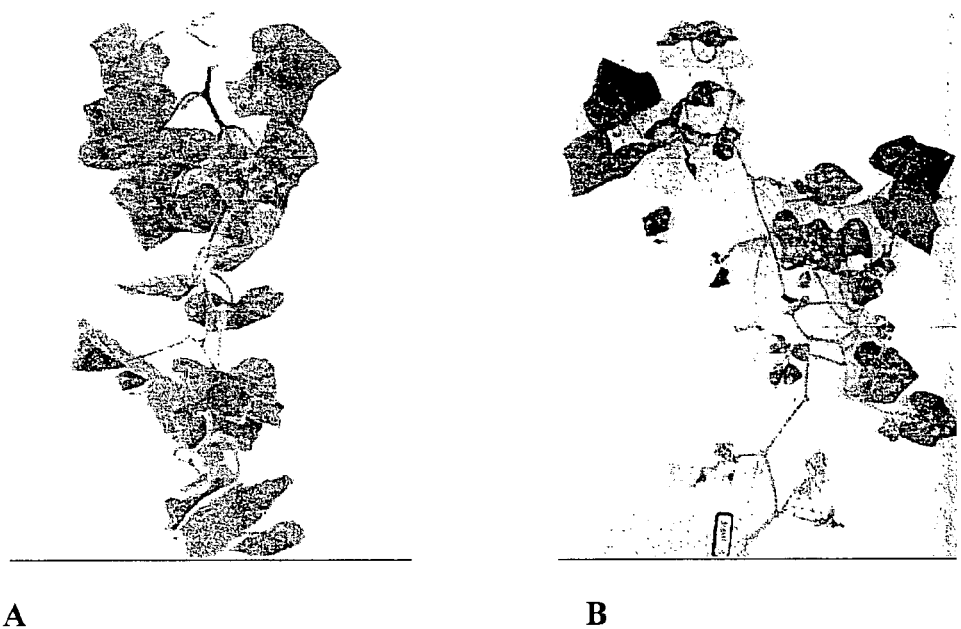

FIG. 147. Representative experiment showing *Arabidopsis* FT-mediated floral induction in *C. moschata* with ZYMV-FT (FIG. 147B) in comparison with the control ZYMV-GFP (FIG. 147A).

Figure 148A:
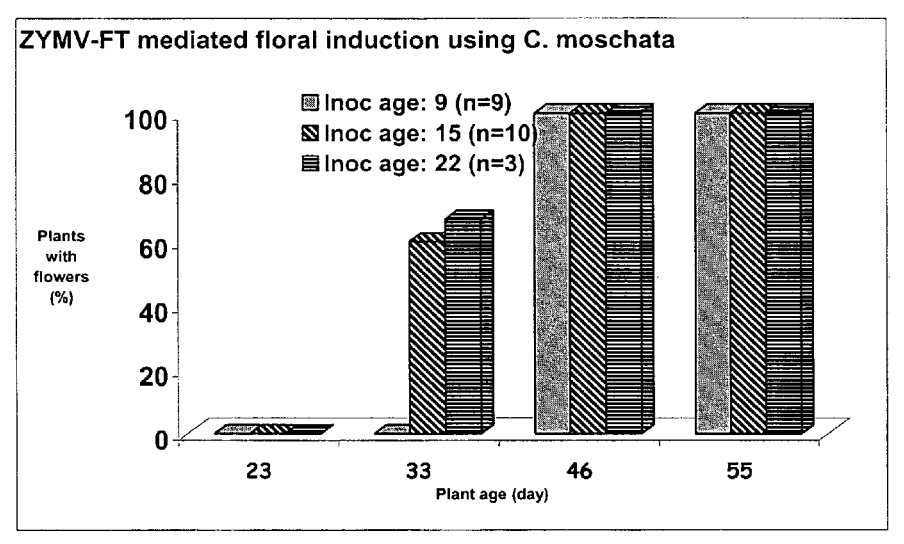
Figure 148B:
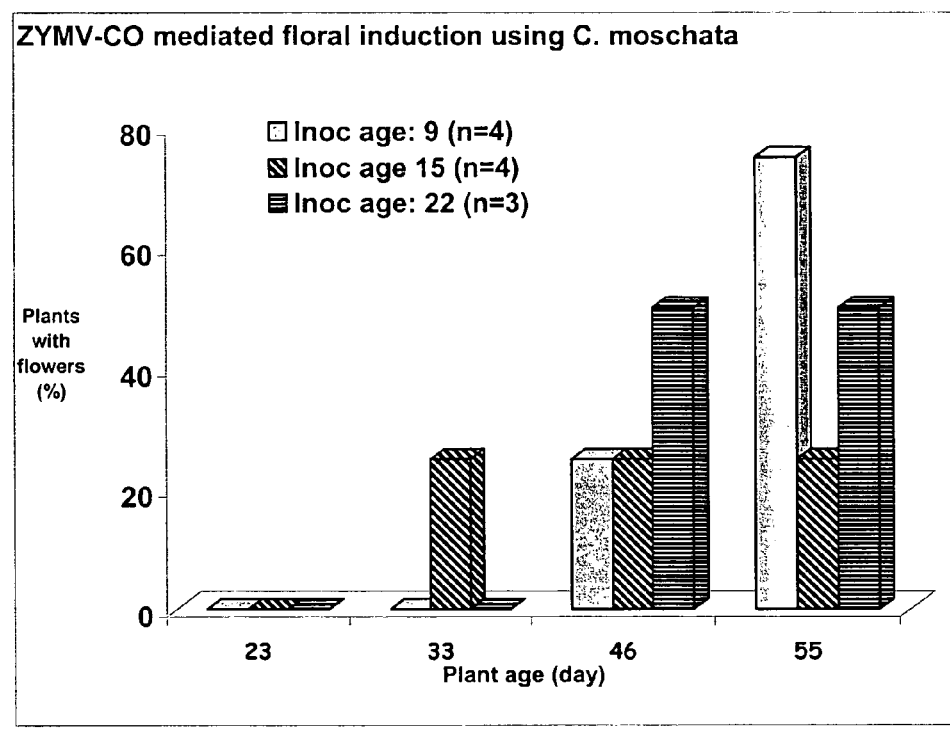
Figure 148C:
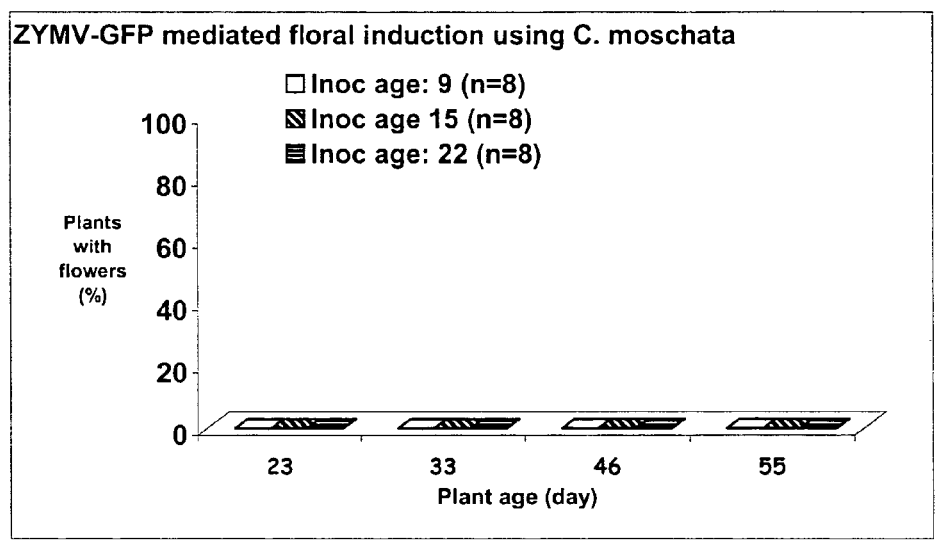

FIG. 148. Flowering induction in *C. moschata* inoculated at different ages with ZYMV-FT (FIG. 148A) and ZYMV-CO (FIG. 148B). No flowering was observed in the control plants under these conditions (FIG. 148C).

Figure 149:
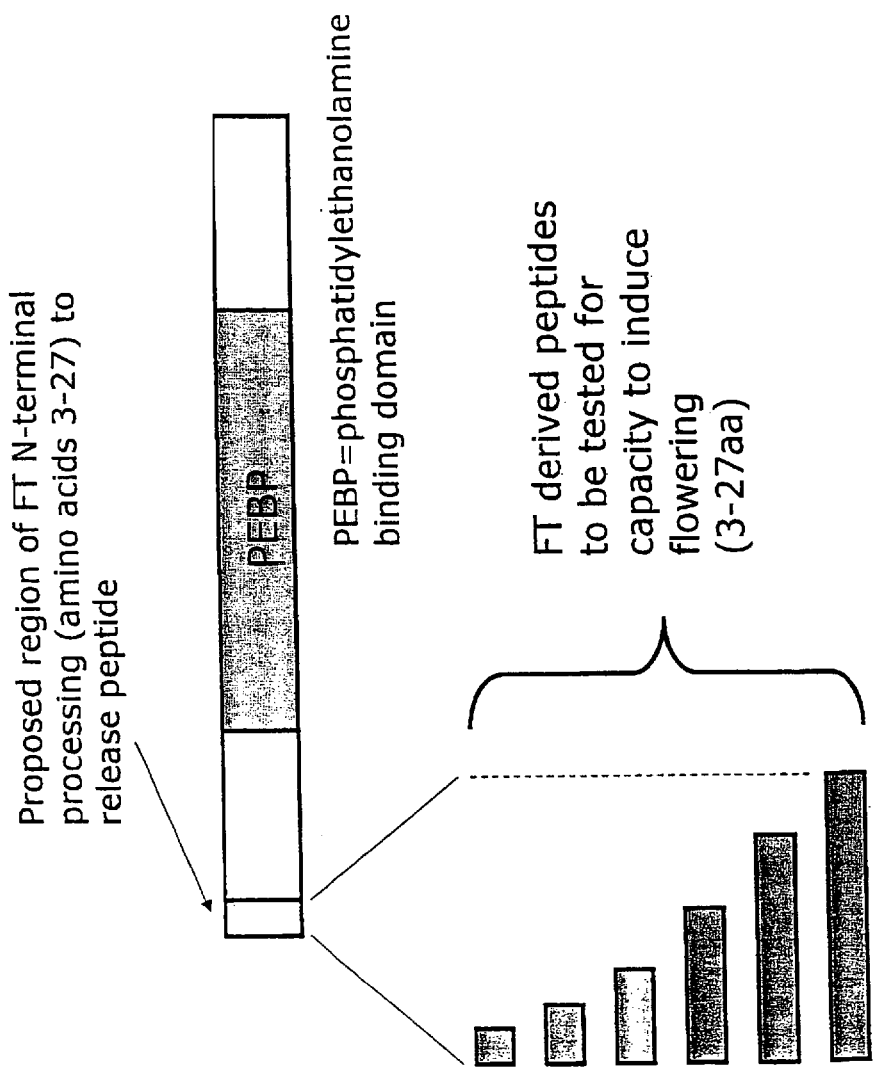

FIG. 149. Diagram showing general location of the PEBP binding site in the FT gene and proposed florigen signal-generating region.

Figure 150:
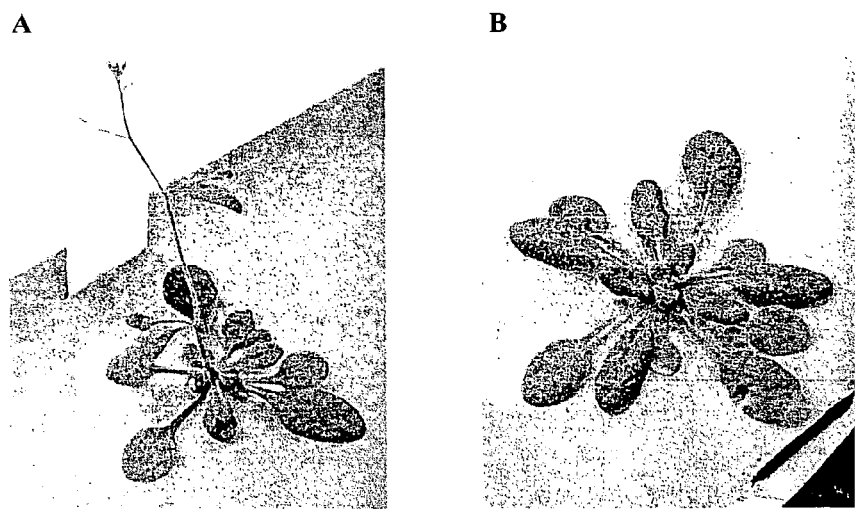

FIG. 150. Effect on flowering induced in *Arabidopsis thaliana* by *C. maxima* FT when expressed as a transgene under the control of a companion cell-specific promoter (FIG. 150A). Control plants grown under the same conditions remained vegetative (FIG. 150B).

FIG. 151. Effect on flowering induced in *Arabidopsis thaliana* by mRNA 158 when expressed as a transgene under the control of a companion cell-specific promoter (FIG. 151A). Control plants grown under the same conditions remained vegetative (FIG. 151B).

DETAILED DESCRIPTION

Previous studies on photoperiodic induction of flowering have shown that perception of a favorable photoperiod occurs in the leaf and involves phytochrome pigments (Blazquez *J. Cell Science* 113:3547–3548 (2000); Koorneef et al., *Annu. Rev. Plant Physiol. Plant Mol. Biol.* 49:345–370 (1998), reviews). Grafting studies provided evidence that a flower-inducing signal is produced in the stimulated leaf and is capable of moving through a graft junction to initiate flowering in the SAM of an unstimulated scion (recipient tissue) grafted to a stimulated stock (perception and production tissue). Genetic studies have identified transcription factors and their target gene pathways in the meristem cells that are involved in floral evocation. The mechanisms of cell-to-cell communication and the role of the phloem transport system in systemic transport of macromolecules between source and sink tissues are under active investigation by a number of laboratories. While it is certain that florigenic signaling is initiated by the perception of an appropriate stimulus by the leaf and culminates in the induction of the flowering response in the SAM, the identity of the florigenic signal(s) and the process by which a florigenic signal is communicated from the leaf to the meristematic target tissues (shoot apical meristem, lateral meristem) have not yet been elucidated.

The present invention describes a florigen signaling system, and methods of modulating the system components, involving a multistep pathway in which the companion cell (CC) of the phloem plays a central role. By analogy with a transmitter element in a communication network, the companion cell is responsible for converting the signal it receives from the leaf sensor cells to a transmissible form which can be propagated in a long-distance communication channel for arrival at an appropriate time and destination point, and in a manner that preserves the information content and intensity of the signal at its point of reception. In this conception, the companion cell is viewed both as the supplier of components required for long-distance systemic transmission of a flower-inducing stimulus from the leaf to the SAM and as a selectivity filter for ensuring that signal-to-noise ratio of the transmission is adequate.

FIG. 1 depicts the florigenic signaling pathway, in which the activation of a signaling cascade in the companion cell gives rise to a concatenated response leading to the induction of flowering. For illustrative purposes, it is assumed that the pathway described below is initiated by photoperiodic induction. However, it is understood that other florigenic inducers, both biotic and abiotic, also operate via this pathway.

As shown in FIG. 1 (step A), the primary stimulus is perceived by a sensor cell in the leaf. The sensor cell perceives short-/long-day conditions via a phytochrome-based circadian clock and generates a signal within one or more cell types present in the leaf (the epidermal, mesophyll, bundle sheath and vascular cells). The signal is relayed to the companion cell (CC) of the functional phloem (step B). The nature of this transmission process and the form which the signal takes is presently unknown. For purposes of the present model, it is presumed that the information is encoded in a chemical molecule, and that the perception of the signal by the CC (step C) involves the recognition and binding of this molecule to a cognate binding partner in or on the CC. The signal may comprise a transcription factor that acts directly on the transcriptional machinery of the CC to activate a florigen-specific pathway, or may act indirectly via a signal cascade mechanism (step D). The florigen-specific pathway involves a suite of genes whose encoded products render the signal transmissible for long-distance delivery. The phrase "renders the signal transmissible" is intended to encompass the production of a long-distance florigen signaling component and/or signaling complex (LDFSC).

The transmissible long-distance flower-inducing stimulus is referred to herein as a "long-distance florigenic signaling component" or "LDFSC". This term is intended to encompass regulatory molecules or complexes containing regulatory molecules which act directly or indirectly to induce the floral transition. The accessory components that function, for example, in the delivery of a florigenic signal from the companion cell to the plasmodesmal system, in stabilization of the florigenic signal during phloem transport, and in unloading of the florigenic signal from the terminal phloem for delivery to the apical meristem are considered to comprise LDFSC, but may also be involved in other types of long-distance signaling processes.

The LDFSC enters the functional, enucleate, sieve tube system (step E), which acts as the conduit for the delivery of the LDFSC to the shoot apex. The LDFSC is a protein/derivative, protein-hormone complex, nucleoprotein, peptide/derivative, a single-stranded or double-stranded nucleic acid molecule/derivative, or a combination of any of the foregoing in covalent or non-covalent linkage. The term "derivative" refers to an LDFSC that is structurally modified by biochemical, chemical, recombinant or genetic techniques.

The CC-SE complexes along the phloem translocation pathway provide a relay system for regenerating and amplifying the LDFSC during the translocation process (step E). The function and location of the regenerating and/or amplifying system in the CC-SE complex depends on the biochemical characteristics of the LDFSC. For example, if the LDFSC is an RNA molecule that serves as its own template for replication, the replicative machinery or part thereof may be cotransported with it in the phloem. For LDFSC that requires de novo transcription or translation, the relay mechanism is likely to be a highly regulated process involving the shuttling of the LDFSC back and forth between the phloem and the CC during translocation.

The egress of the LDFSC at the terminal phloem (sieve tubes) involves at least one of the following processes: (i) targeted transport through plasmodesmata into CCs or neighboring phloem parenchyma and (ii) activation of a secondary relay in vascular cells which propagates via plasmodesmata and/or the apoplasm to the SAM and initiates floral development (steps F—H); or (iii) direct transfer of the LDFSC through the apex via PD or the apoplasm into the SAM (step I) to initiate floral development. The mechanism is likely to depend on such factors as the molecular size and shape of the LDFSC in relation to the size exclusion limit (SEL) of plasmodesmata and/or movement via the apoplasm in postphloem tissues, whether specific signals are present for targeting the LDFSC to the meristem or retaining it in the SE-CC complex, and whether the LDFSC requires conversion into a different form for cell-to-cell transport or for activation of the vegetative to floral transition in the SAM. For a general review of phloem transport and unloading of macromolecules, see Oparka and Santa Cruz, *Annu. Rev. Plant Physiol. Plant Mol. Biol.* 51: 323–47 (2000) and Schobert, C., Lucas, W. J., Franceschi, V. R., and Frommer, W. B. (2000) Intercellular transport and phloem loading of sucrose, oligosaccharides and amino acids. Advances in Photosynthesis, Vol. 9, Photosynthesis: Physiology and Metabolism, eds. R. C. Leegood, T. D. Sharkey and S. von Caemmerer, pp. 249–274.

The present invention provides methods for (1) identifying the LDFSC and other genes in the florigenic signaling cascade; (2) modifying the occurrence, timing and extent of flower development by modulating the florigenic signaling pathway; and (3) screening for inducers, repressors and modulators of florigenic signaling.

In one of its aspects, the invention provides a method for identifying a candidate flowering control gene in the long-distance florigenic signaling pathway. The method comprises: comparing the gene transcripts or transcription products in the phloem sap of florally induced and noninduced plants and identifying a product that is differentially expressed during the floral transition.

In a related aspect, the invention provides a method of isolating an LDFSC, which comprises exposing a plant or heterograft to a flowering stimulus, identifying a gene transcript or transcription product that appears in the phloem sap, and ascertaining the ability of the gene product to affect floral induction in a plant.

The phrase "gene transcript or transcription product" refers to all products that are derived from the expression of a gene, including, for example, RNA and polypeptide molecules that are processed from precursor molecules or are otherwise modified after transcription and/or translation.

The invention further provides isolated polynucleotide sequences from cucurbits, *Arabidopsis*, *Pinus* and *Festuca* that encode putative regulators of long-distance florigenic signaling.

The word "polynucleotide(s)," as used herein, means a polymeric collection of nucleotides, and includes DNA and corresponding RNA molecules and both single and double stranded molecules, including HnRNA and mRNA molecules, sense and anti-sense strands of DNA and RNA molecules, and comprehends cDNA, genomic DNA, and wholly or partially synthesized polynucleotides.

A polynucleotide of the present invention may be an entire gene or any portion thereof. As used herein, a "gene" is a DNA sequence that codes for a functional protein or RNA molecule. Operable anti-sense polynucleotides may comprise a fragment of the corresponding polynucleotide, and the definition of "polynucleotide" therefore includes all operable anti-sense fragments. Anti-sense polynucleotides and techniques involving anti-sense polynucleotides are well known in the art and are described, for example, in Robinson-Benion et al., *Methods in Enzymol.* 254(23): 363–375, 1995 and Kawasaki et al., *Artific. Organs* 20(8): 836–848, 1996.

Polynucleotides that comprise complements of such polynucleotide sequences, reverse complements of such polynucleotide sequences, or reverse sequences of such polynucleotide sequences, together with variants of such sequences, are also provided.

Table 1, below provides additional information about these sequences. These polynucleotide sequences are identified in the Sequence Listing as SEQ ID NOs: 1–25, 119–151, 271–298, 377–380, 561–638 (cucurbits); SEQ ID NOs: 51–75, 185–217 and 299–322, 405–482 (*Arabidopsis* orthologs), SEQ ID NO: 323 (*Pinus radiata* ortholog), and SEQ ID NOs: 717–794 (*Festuca arundinacea*). Their encoded polypeptide sequences are identified respectively as SEQ ID NOs. 26–50, 152–184, 324–351, 381, 382, 639–716 (cucurbits); SEQ ID NOs. 76–100, 218–250, 352–375, and 483–560 (*Arabidopsis* orthologs), SEQ ID NO: 376 (*Pinus radiata* ortholog); and SEQ ID NOs: 795–872 (*Festuca arundinacea*). SEQ ID NOs. 132 and 165 are respectively the polynucleotide and encoded polypeptide sequence of *C. maxima*; SEQ ID NOs: 198 and 231 are respectively the polynucleotide and encoded polypeptide sequence of *A. thaliana* FT, and SEQ ID NOs: 323 and 376 are respectively the polynucleotide and encoded polypeptide sequence of *P. radiata* FT.

As used herein, the term "polypeptide" encompasses amino acid chains of any length, including full-length proteins, wherein the amino acid residues are linked by covalent peptide bonds. The term "polypeptide encoded by a polynucleotide" as used herein, includes polypeptides encoded by a polynucleotide that comprises a partial isolated polynucleotide sequence provided herein.

Polypeptides of the present invention may be produced recombinantly by inserting a polynucleotide sequence of the present invention encoding the polypeptide into an expression vector and expressing the polypeptide in an appropriate host. Any of a variety of expression vectors known to those of ordinary skill in the art may be employed. Expression may be achieved in any appropriate host cell that has been transformed or transfected with an expression vector containing a polynucleotide molecule that encodes a recombinant polypeptide. Suitable host cells include prokaryotes, yeast, and higher eukaryotic cells. Preferably, the host cells employed are plant, *E. coli*, insect, yeast, or a mammalian cell line such as COS or CHO. The polynucleotide sequences expressed in this manner may encode naturally occurring polypeptides, portions of naturally occurring polypeptides, or other variants thereof. The expressed polypeptides may be used in various assays known in the art to determine their biological activity. Such polypeptides may also be used to raise antibodies, to isolate corresponding interacting proteins or other compounds, and to quantitatively determine levels of interacting proteins or other compounds.

TABLE 1

| Polynucleotide SEQ ID NO: | Polypeptide SEQ ID NO: | Homology |
|---|---|---|
| 1, 51 | 26, 76 | Leafy (LHY) protein that plays a role in flower meristem identity. |
| 2, 3, 52, 53 | 27, 28, 77, 78 | Regulator identified in the phloem |
| 4, 54 | 29, 79 | SEUSS transcriptional co-regulator |
| 5, 55 | 30, 80 | Zinc finger transcription factor that plays a role in regulating gene transcription |
| 6, 56 | 31, 81 | AP2 domain transcription factor that plays a role in regulating gene transcription |
| 7, 57 | 32, 82 | NAM/CUC2-like protein that plays a role in regulating gene transcription |
| 8, 58 | 33, 83 | Ripening-related bZIP transcription factor that plays a role in regulating gene transcription |
| 9, 59 | 34, 84 | C3H-type zinc finger transcription factor that plays a role in regulating gene transcription |
| 10, 60 | 35, 85 | Ethylene responsive element binding factor 4 (AtERF4) that plays a role in regulating gene transcription |
| 11, 61 | 36, 86 | Auxin response factor 9 (ARF9) that plays a role in regulating gene transcription |
| 12, 62 | 37, 87 | Aux/IAA protein that plays a role in regulating gene transcription |
| 13, 63 | 38, 88 | ARR2 protein that plays a role in regulating gene transcription |
| 14, 64 | 39, 89 | Heat shock transcription factor that plays a role in regulating gene transcription |
| 15, 65 | 40, 90 | WRKY-type DNA binding protein that plays a role in regulating gene transcription |
| 16, 66 | 41, 91 | F4H5 |
| 17, 67 | 42, 92 | Regulator identified in the phloem |
| 18, 68 | 43, 93 | Transcription factor that plays a role in regulating gene transcription |
| 19, 69 | 44, 94 | Transcription factor that plays a role in regulating gene transcription |
| 20, 70 | 45, 95 | Regulator identified in the phloem |
| 21, 71 | 46, 96 | Nam-like transcription factor that plays a role in regulating gene transcription |
| 22, 72 | 47, 97 | Avr9/Cf-9 rapidly elicited protein that plays a role in regulating gene transcription |

TABLE 1-continued

| Polynucleotide SEQ ID NO: | Polypeptide SEQ ID NO: | Homology |
|---|---|---|
| 23, 73 | 48, 98 | Stress-responsive zinc finger protein ZPT2-11 that plays a role in regulating gene transcription |
| 24, 74 | 49, 99 | Nam-like transcription factor that plays a role in regulating gene transcription |
| 25, 75 | 50, 100 | WRKY-type DNA binding protein that plays a role in regulating gene transcription |
| 119, 185 | 152, 218 | Plays a role in regulating chromatin structure and epigenetic functions |
| 120, 186 | 153, 219 | Transcription factor that plays a role in regulating gene transcription |
| 121, 187 | 154, 220 | Plays a role in small RNA metabolism |
| 122, 188 | 155, 221 | Regulator identified in the phloem |
| 123–125, 189–191 | 156–158, 222–224 | Transcription factor that plays a role in regulating gene transcription |
| 126, 192 | 159, 225 | Transcription factor that plays a role in regulating chromatin structure and epigenetic functions |
| 127, 128, 193, 194 | 160, 161, 226, 227 | Transcription factor that plays a role in regulating gene transcription |
| 129, 195 | 162, 228 | Plays a role in regulating chromatin structure and epigenetic functions |
| 130, 196 | 163, 229 | Plays a role in regulating chromatin structure and epigenetic functions |
| 131, 197 | 164, 230 | Transcription factor that plays a role in regulating gene transcription |
| 132, 198, 323 | 165, 231, 376 | Flowering Locus T (FT) that plays a role in regulation of flowering in plants |
| 133, 199 | 166, 232 | Plays a role in regulating chromatin structure and epigenetic functions |
| 134, 200 | 167, 233 | Plays a role in small RNA metabolism |
| 135–137, 201–203 | 168–170, 234–236 | Plays a role in regulating chromatin structure and epigenetic functions |
| 138, 204 | 171, 237 | Transcription factor that plays a role in regulating gene transcription |
| 139, 140, 205, 206 | 172, 173, 238, 239 | Plays a role in regulating chromatin structure and epigenetic functions |
| 141, 207 | 174, 240 | Transcription factor that plays a role in regulating gene transcription |
| 142, 208 | 175, 241 | Plays role in carbohydrate metabolism |
| 143, 144, 209, 210 | 176, 177, 242, 243 | Plays a role in regulating chromatin structure and epigenetic functions |
| 145, 211 | 178, 244 | SPINDLY protein that plays a role in the gibberelin signaling pathway |
| 146, 212 | 179, 245 | GIGANTEA protein that plays a role as output from the circadian clock |
| 147–149, 213–215 | 180–182, 246–248 | Plays a role in regulating chromatin structure and epigenetic functions |
| 150, 216 | 183, 249 | Transcription factor that plays a role in regulating gene transcription |
| 151, 217 | 184, 250 | Plays a role in intracellular protein transport |
| 377, 378 | 381 | Zinc finger protein that plays a role in regulating gene transcription |
| 379, 380 | 382 | DNA binding protein that plays a role in regulating gene transcription |

Polynucleotide sequences with SEQ ID NOs. 271–322 encode regulatory molecules which include putative orthologs of SIPs described in Pneuli et al., *Plant Cell* 13:2687–2702 (2001). The following Table provides additional information about these sequences.

TABLE 2

| POLY-NUCLEOTIDE SEQ ID NO | POLYPEPTIDE SEQ ID NO | HOMOLOGY | PLANT |
|---|---|---|---|
| 271, 272 | 324, 325 | SPAK | *Cucumis sativus* |
| 273–275 | 326–328 | SPGB (bZIP) | *Cucumis sativus* |
| 276 | 329 | SIP4 (10 kDa) | *Cucurbita maxima* |
| 277–281 | 330–334 | SPGB (bZIP) | *Cucurbita maxima* |
| 282–284 | 335–337 | SPGB (bZIP) | *Sicyos angulatus* |
| 285–289 | 338–342 | 14-3-3/2 | *Cucumis sativus* |
| 290–297 | 343–350 | 14-3-3/2 | *Cucurbita maxima* |
| 298 | 351 | 14-3-3/2 | *Sicyos angulatus* |
| 299, 300 | 352, 353 | SPAK | *A. thaliana* |
| 301 | 354 | SIP4 (10 kDa) | *A. thaliana* |
| 302–309 | 355–362 | SPGB (bZIP) | *A. thaliana* |
| 310–316 | 363–369 | 14-3-3/2 | *A. thaliana* |
| 317 | 370 | SPGB (bZIP) | *A. thaliana* |
| 318, 319 | 371, 372 | 14-3-3/2 | *A. thaliana* |
| 320–322 | 373–375 | SPAK | *A. thaliana* |

Genetic constructs comprising the polynucleotide sequences and host organisms comprising these constructs are also encompassed by the present invention. The term "genetic construct" refers to recombinant genetic constructs comprising, in the 5'–3' direction, a gene promoter sequence; an open reading frame coding for at least a functional portion of a polypeptide of the present invention; and a gene termination sequence. The open reading frame may be orientated in either a sense or anti-sense direction. For applications where amplification of gene transcripts and transcription products is desired, the open reading frame may be inserted in the construct in a sense orientation, such that transformation of a target organism with the construct will lead to an increase in the number of copies of the gene and therefore an increase in the amount of gene transcripts and transcription products. When down-regulation of gene transcripts and transcription products is desired, the open reading frame may be inserted in the construct in an anti-sense orientation, such that the RNA produced by transcription of the polynucleotide is complementary to the endogenous mRNA sequence. This, in turn, will result in a decrease in the amount of gene transcription products. Alternatively, regulation may be achieved by inserting appropriate sequences or subsequences (e.g., DNA or RNA) in ribozyme constructs.

Genetic constructs comprising a non-coding region of a gene coding for a polypeptide of the present invention, or a nucleotide sequence complementary to a non-coding region, together with a gene promoter sequence and a gene termination sequence, are also provided. As used herein the term "non-coding region" includes both transcribed sequences that are not translated, and non-transcribed sequences within about 2000 base pairs 5' or 3' of the translated sequences or open reading frames. Examples of non-coding regions that may be usefully employed in the inventive constructs include introns and 5'-non-coding leader sequences. Transformation of a target plant with such a genetic construct may lead to a reduction in the amount of enzyme synthesized by the plant by the process of cosuppression, in a manner similar to that discussed, for example, by Napoli et al., *Plant Cell* 2:279–290, 1990; and de Carvalho Niebel et al., *Plant Cell* 7:347–358, 1995.

The genetic constructs of the present invention further comprise a gene promoter sequence and a gene termination sequence, operably linked to the polynucleotide to be transcribed, which control expression of the gene. The gene promoter sequence is generally positioned at the 5' end of the polynucleotide to be transcribed, and is employed to initiate transcription of the polynucleotide. Gene promoter sequences are generally found in the 5' non-coding region of a gene but they may exist in introns (Luehrsen, *Mol. Gen. Genet.* 225:81–93, 1991). When the construct includes an open reading frame in a sense orientation, the gene promoter sequence also initiates translation of the open reading frame. For genetic constructs comprising either an open reading frame in an anti-sense orientation or a non-coding region, the gene promoter sequence consists only of a transcription initiation site having a RNA polymerase binding site.

A variety of gene promoter sequences that may be usefully employed in the genetic constructs of the present invention are well known in the art. The promoter gene sequence, and also the gene termination sequence, may be endogenous to the host organism, e.g., target plant host, or may be exogenous, provided the promoter is functional in the target host. For example, the promoter and termination sequences may be from other plant species, plant viruses, bacterial plasmids and the like. Preferably, gene promoter and termination sequences are from the inventive sequences themselves.

Factors influencing the choice of promoter include the desired tissue specificity of the construct, and the timing of transcription and translation. For example, constitutive promoters, such as the 35S Cauliflower Mosaic Virus (CaMV 35S) promoter, will affect the activity of the enzyme in all parts of the plant. Use of a tissue specific promoter will result in production of the desired sense or anti-sense RNA only in the tissue of interest. With genetic constructs employing inducible gene promoter sequences, the rate of RNA polymerase binding and initiation can be modulated by external physical or chemical stimuli, such as light, heat, anaerobic stress, alteration in nutrient conditions and the like. Temporally regulated promoters can be employed to effect modulation of the rate of RNA polymerase binding and initiation at a specific time during development of a transformed cell.

The gene termination sequence, which is located 3' to the polynucleotide to be transcribed, may come from the same gene as the gene promoter sequence or may be from a different gene. Many gene termination sequences known in the art may be usefully employed in the present invention, such as the 3' end of the *Agrobacterium tumefaciens* nopaline synthase gene. However, preferred gene terminator sequences are those from the original gene or from the target species to be transformed.

Other regulatory sequences may be included in the construct, such as transcriptional and translational enhancers.

The genetic constructs of the present invention may also contain a selection marker that is effective in plant cells, to allow for the detection of transformed cells containing the inventive construct. Such markers, which are well known in the art, typically confer resistance to one or more toxins. One example of such a marker is the NPTII gene whose expression results in resistance to kanamycin or hygromycin, antibiotics which are usually toxic to plant cells at a moderate concentration (Rogers et al., in Weissbach A and H, eds., *Methods for Plant Molecular Biology*, Academic Press Inc.: San Diego, Calif., 1988). Alternatively, the presence of the desired construct in transformed cells can be determined by means of other techniques well known in the art, such as Southern and Western blots.

Techniques for operatively linking the components of the inventive genetic constructs are well known in the art and include the use of synthetic linkers containing one or more restriction endonuclease sites as described, for example, by Sambrook et al., *Molecular cloning: a laboratory manual*, CSHL Press: Cold Spring Harbor, N.Y., 1989. The genetic construct of the present invention may be linked to a vector having at least one replication system, for example, *E. coli*, whereby after each manipulation, the resulting construct can be cloned and sequenced and the correctness of the manipulation determined.

The expression of polynucleotide sequences in target cells may be controlled by choice of the promoter sequence, or by selecting the number of functional copies or the site of integration of the polynucleotides incorporated into the genome of the target organism. A target plant may be transformed with more than one construct of the present invention, thereby modulating flowering in the plant by affecting the activity of more than one polypeptide, affecting polypeptide activity in more than one tissue or affecting polypeptide activity at more than one expression time. Similarly, a construct may be assembled containing more than one open reading frame coding for a polypeptide encoded by a polynucleotide of the present invention or more than one non-coding region of a gene coding for such polypeptide. The polynucleotides of the present invention may also be employed in combination with other known sequences encoding polypeptides involved in various metabolic and biosynthetic pathways. In this manner, more than one pathway may be modulated to produce a plant having an altered flowering phenotype.

Techniques for stably incorporating DNA constructs into the genome of target plants are well known in the art and include *Agrobacterium tumefaciens* mediated introduction, electroporation, protoplast fusion, injection into reproductive organs, injection into immature embryos, high velocity projectile introduction and the like. The choice of technique will depend upon the target plant to be transformed.

Plants which may be transformed using the inventive constructs include both monocotyledonous angiosperms (e.g., grasses, corn, grains, oat, wheat and barley) and dicotyledonous angiosperms (e.g., *Arabidopsis*, tobacco, legumes, alfalfa).

FIGS. 2–48 and 51–146 show amino acid sequences annotated with their conserved InterPro domains. The annotations are based on BLASTX using the cucurbit candidate consensus nucleotide sequence (using default BLASTX parameters) to identify related (orthologous) sequences in SwissProt/TrEMBL peptide database (June 2003). The associated description of the suspected ortholog then serves to annotate the cucurbit gene. As an extra measure of confidence TBLASTN (using default parameters) is then performed using the suspected orthologous peptide sequence identified from SwissProt/TrEMBL peptide database to determine if the top reciprocal hit is the original cucurbit consensus sequence.

1. Identification of Genes Involved in the Long-Distance Florigenic Signaling Pathway A. Characteristics of Florigen Signaling Genes Genes involved in long-distance florigenic signaling may have one or more of the following characteristics:
  (i) Gene transcription and/or activation is responsive to a flowering stimulus and occurs in phloem-containing tissues.
  (ii) Changes in the level of transcripts or expressed products are required for floral induction.
  (iii) Genes are differentially expressed in flowering and non-flowering plants.
  (iv) The presence of post-transcriptionally modified forms (e.g., phosphorylation status) of gene products that are differentially expressed in flowering and non-flowering plants
    The presence of unique transcripts or transcription products of these genes in the phloem sap correlates with the floral transition.
  (v) One or more of the gene transcripts or transcription products is able to move via the phloem and be delivered to the terminal phloem and/or the shoot apex.
  (vi) At least one of the phloem-mobile gene transcripts or gene transcription products directly or indirectly affects floral induction in a plant.

B. Plant Systems and Control of Floral Induction

Any plant that is developmentally competent to flower and undergoes flower induction under defined experimental conditions is potentially useful for identifying long distance flowering control molecules. Preferably, plants that are used are amenable to sampling of the phloem translocation stream, insofar as this permits the direct analysis of phloem-mobile gene transcripts/transcription products. Thus members of the cucurbit family (e.g., pumpkin and cucumber, Ruiz-Medrano, *Development* 126:4405–4419 (1999)), lupin, *Ricinus communis* (Sakuth et al., *Planta* 191:207–213 (1998)) and some trees species including *Eucalyptus globulus* (Pate et al., *Oecologia* 117:312–322 (1998)), *Robinia* and *Tilia* (Schobert et al., *Planta* 206:245–252 (1998)) are particularly useful in this regard. Phloem sap can be collected from the above plants by incision wounding, followed by bleeding, and can also be collected from most plant species by cutting the petiole/stem under a solution of EGTA.

In the process of identifying genes involved in the long-distance florigenic signaling pathway, it is useful to compare plants/plant systems that are induced to flower in different ways, for example, photoperiod-induced flowering, graft-induced flowering or flowering induced by other abiotic or biotic stimuli known to those skilled in the art. The term "abiotic stimulus" is used herein to refer to a non-living stimulus, e.g., light, photoperiod, pH, temperature, water, osmotic stress, and the like. The term "biotic stimulus" is used herein to refer to a living stimulus, e.g., pathogens, signaling molecules, factors, and others.

Exemplary plants for photoperiod-induced flowering include *Sicyos angulatus* and related species of *Sicyoeae*, e.g., *Polakowskia* spp. and *Sechium* spp., such as *Sechium edule* (choko) (Heywood, *Flowering plants of the world*, Oxford (1978)). These species are maintained in a non-flowering state under long day photoperiods and are induced to flower following a treatment of short day photoperiods (Takahashi et al., *Plant Cell Physiol.* 23:1–9 (1982)). The plant systems for identifying florigen candidates as described herein include *Sicyos angulatus* (Bur Cucumber), *Cucurbita moschata* (butternut), *C. maxima* (pumpkin) and *Cucumis sativus* (cucumber), *N. tabacum* cv Maryland mammoth, *N. tabacum* cv Samsun, *N. sylvestris*, *N. benthamiana*, and heterografts of *C. sativus/C. maxima*, *C. sativus* (stock)/*Sicyos angulatus* (scion), *N. tabacum* cv Samsun (stock)/*N. tabacum* cv Maryland mammoth (scion), *Cucumis sativus* cv Straight 8 (stock)/*Cucurbita moschata* PI441726 (scion), and early and late flowering accessions of *C. moschata* (*Cucurbita* moschata PI212011 and PI441726) respectively.

We have characterized and are using several different plant systems to study flowering control genes. For example, heterografts of naturally occurring early and late flowering variants of *C. moschata* plants are used to identify and isolate florigen candidate genes. Cucumber heterografts (Friedlander et al., *Plant Cell Physiol.* 18:1343–1350 (1977)) or pumpkin/cucumber heterografts are used to test for the presence of a graft transmissible florigenic signal or florigenic suppressor. Heterografts comprised of an early-flowering rootstock and late-flowering scion are useful for detecting signals that induce flowering, whereas heterografts comprising a vegetative rootstock and early flowering scion can be used to detect suppressors of flowering. Following confirmation that a graft-transmissible signal is produced in a particular plant heterograft system, phloem mobile gene products that correlate with floral induction or suppression can be identified (e.g., mRNA, peptides, proteins and miRNA). Additional details of the plant systems are given in Examples 1 and 2 below.

C. Bioinformatic Selection of Candidate Genes:

(1) Construction of Phloem Sap Libraries

The phloem sap is the port of entry of components of long-distance systemic signaling. The companion cells supply all components of the sieve tube system, and control the transport of phloem-mobile molecules into the phloem. Insofar as the methods for separating phloem (CC and SE) from surrounding tissues are not yet available, the phloem-containing tissues (i.e., roots, stems, petioles, leaf veins, and vascular strands) and preferably, the phloem sap, can be used to prepare cDNA libraries. Our studies thus far have shown phloem sap to be an excellent starting material for the isolation of putative regulators of long-distance florigenic signaling.

Phloem sap libraries were constructed as described below in Example 3. The EST sequences were databased and assembled into consensus sequences using Stackpack™, version 1.2 (Electric Genetics Corporation, Cape Town, South Africa). Prior to assembly of consensi, the database EST sequences were curated to remove 1) repetitive sequences at sequence read termini flanked by polyA or polyT of at least 20 basepairs; 2) polyA or polyT sequences longer than 20 basepairs (replaced by one A or T); and 3) those exact duplicate sequences that were found to disturb the assembly procedure. The masking file used in the assembly contained sequences known to disturb assembly, including commonly used vectors and various repeats, as well as selected plant ribosomal RNA sequences.

(2). In Silico Analysis of Differential Expression

The EST member status for consensi is used to develop an in silico expression profile for all databased consensus sequences. This provides the frequency for any consensus (gene) per 1000 EST runs. Knowledge of the tissue from which the consensus EST members were derived, e.g., phloem sap from flowering or non-flowering plants, provides the relative contribution of particular tissues to EST members for a given consensus sequence.

(3). Criteria for Selection of Flowering Control Candidate Genes for in Planta Analysis Candidate flowering control genes are selected from cucurbit phloem sap and phloem tissue cDNA libraries for in planta analysis based on several criteria. Of particular interest, for example, are:
  a. Consensi that show hits to Swissprot/Tremble or *Arabidopsis* sequences that are known or putative regulatory genes, e.g. transcription factors and chromatin remodelling genes, kinases involved in regulatory signaling, and so on.
  b. Cucurbit consensi that meet the above criterion and also contain one or more InterPro domains that are found in regulatory genes, e.g., transcriptional regulators and genes involved in chromatin remodeling
  c. Consensi from phloem sap libraries that encode known floral regulators and would be expected to induce flowering if expressed in companion cells or associated tissues of transgenic plants, e.g., known floral homeotic genes.
  d. Consensi that are likely to represent phloem-sap derived genes. Normalized expression values, as described above in (2), "In silico analysis of differential expression", are used to prioritize likely phloem sap derived consensi (genes). Here the ratio of values derived from phloem sap derived libraries (combined values for flowering and non-flowering) and solid tissue (e.g. vascular strips from stem tissue) are used to prioritize candidates.
  e. Consensi (genes) that are conserved between species at the nucleotide level, e.g., consensi having EST members that are represented in more than one cucurbit species (e.g., *Cucurbita moschata*, *Cucurbita maxima*, *Cucumis sativus*, and *Sicyos angulatus*).
  f. Consensi (genes) that are conserved between species at the protein level, e.g., consensi derived from phloem sap of multiple cucurbit species that show a top hit to the same Swissprot/Tremble gene ID or TAIR *Arabidopsis* peptide sequence.
  g. Consensi showing a biased contribution of EST members from either flowering or non-flowering phloem sap. This is calculated from in silico data as described above in (2), "In silico analysis of differential expression". Here the ratio of values derived from phloem sap (flowering plants) derived libraries and phloem sap (non-flowering plants) are used to prioritize candidates. This is considered to be one of several indicia of differential gene expression in flowering and non-flowering plants (see below).

Consensi that satisfy more than one of the above criteria are judged to have an increased likelihood of being involved in phloem-mediated regulatory activities.

D. Other Analytical Approaches for Selection of Candidate Genes (1). Real Time RT-PCR Analysis of Differential Expression Real time PCR is used to evaluate the relative levels of candidate gene transcript accumulation in flowering and non-flowering tissue and provides a means of refining the candidate gene selections based on in silico expression analysis. cDNA templates for the assay are synthesized from total RNA extracted from tissue (leaves, apices or vascular strips from the stem) or phloem sap derived from flowering or non-flowering plants using random primers and Reverse Transcriptase Super Script III. Real time quantification is performed using the cDNA template with a specific set of oligonucleotide primers for each candidate. The primer pairs are designed based on the consensus coding sequence of each cucurbit candidate. The PCR amplification is monitored by fluorescence emitted by the SYBR Green dye included in the PCR mix. The SYBR Green dye emits an increased fluorescence when bound to double-stranded DNA. The fluorescence is measured at each cycle of amplification using the ABI PRISM® 7900HT Sequence Detection System.

The relative abundance of each target is calculated as follows. The Threshold Cycle (CT) for each candidate included in the reaction is measured as the fractional cycle number at which the fluorescence passes a fixed threshold. The delta CT value is then determined by subtracting the CT value of the endogenous control (e.g., PP1, WRKY or GAI) from the CT value of the candidate. The relative abundance of the candidate is then calculated by subtracting the delta CT value of the candidate in non-flowering tissue from the delta CT value of the same candidate in flowering tissue.

(2). Macroarray Analysis of Differential Expression

Expression profiling of flowering and non-flowering cucurbits is performed by macroarray analysis, as described below.

Plasmid DNA (10–100 ng) comprising cucurbit candidate genes are arrayed onto Hybond N+ membrane (Amersham), denatured and fixed by baking or UV cross-linking. Phloem and vascular tissue RNA is isolated from flowering and non-flowering plants, reverse-transcribed, and labeled. Probes with equal specific activity are hybridized to the plasmid DNA array overnight at 65° C. in a solution containing 0.5 M $Na_2HPO_4$, 1 mM EDTA, 1% BSA, and 7% SDS. Blots are washed twice for 10 min in 2×SSC, 0.1% SDS at 65° C. Signal is detected using a phosphorimager.

(3) Protein and Peptide Analysis

The phloem sap is a source of proteins, peptides, small RNA molecules, and protein-small RNA complexes that may be involved in flowering control. The phloem sap also contains proteins that are involved in cell-to-cell trafficking of mRNA and small RNA molecules. The proteins and peptides can be extracted and separated by chromatographic and electrophoretic techniques, and their profiles compared in plants in flowering and non-flowering states to identify products specific to floral induction. Useful approaches for identifying and analyzing changes in phloem-mobile proteins and peptides during the floral transition in cucurbits include 2-D Fluorescence Difference Gel Electrophoresis (Ettan™ DIGE, Amersham Biosciences), high pressure liquid chromatography (HPLC), gel filtration chromatography (GFC) and mass fingerprinting and fragmentation analysis (see, e.g., Shevchenko et al., *Proc. Natl. Acad. Sci. USA* 93: 14440–14445 (1996); Washburn et al., *Nature Biotech.* 19: 242–247 (2001)).

The temporal appearance and spatial distribution of phloem-mobile proteins and RNA of interest can be followed in plant tissues during the floral transition using both histological and microinjection techniques. (see General Methods below).

E. Small RNA (sRNA) Phloem Mobile Regulators of Flowering

Small RNA molecules are single stranded or double stranded noncoding RNA molecules generally in the range of 18–25 nt in length. They include microRNAs, which are single stranded and produced by the cleavage of short stem-loop precursors by Dicer-like enzymes, and small interfering RNAs (siRNAs), which are produced by the cleavage of long double-stranded RNA molecules.

The small RNAs in the phloem may play important roles in non-cell autonomous signaling events which occur between cells and over long distances in the plant, and are implicated in a broad spectrum of plant developmental, physiological and biochemical processes, e.g., flowering, coordination of plant growth and development, systemic resistance to pathogens, responses to environmental stresses, gene silencing related to viral defense, biomass distribution, regulation of carbon metabolism, control of plant size and developmental timing and patterning. Small RNA species produce epigenetic changes in gene expression patterns by processes as diverse as targeted degradation, chromatin methylation and arrest of translation.

Our analyses of phloem-mobile RNA populations of cucurbits demonstrated the presence of small RNA molecules in phloem sap and in vascular strands of cucurbits. These small RNA species were cloned (see Example 4), sequenced, and databased, and their size distribution and complexity was analyzed. The authenticity of the phloem small RNAs was confirmed by comparisons with cucurbit genomic sequences.

(1). Selection Criteria for sRNA Candidates

The identification of candidate sRNAs as flowering control regulators is based in part upon bioinformatic criteria that are applied to the databased sRNA sequences to distinguish sRNA from contaminating fragments of other non-coding RNAs. MicroRNA sequences (miRNAs) are annotated according to the following guidelines proposed by Ambros et al. (see Ambros et al., *RNA* 9:277–279 (2003)):

(a) phylogenetic conservation of the miRNA sequence, determined bioinformatically;

(b) biogenesis criteria (identification of the putative precursor by prediction of a potential fold-back structure), also determined bioinformatically; and (c) expression criteria (identification of sequence in a library of cDNA made from size-fractionated RNA; detection of a distinct ~22 nt RNA transcript by hybridization to a size-fractionated RNA sample).

Small RNA ranging from 19–25 nt in length are subjected to FASTA analysis against *Arabidopsis* rRNA and tRNA. FASTA hits with up to 2 mismatches are discarded as probable structural RNA contamination. The remaining sequences and their reverse complements are subjected to FASTA analysis against *Arabidopsis* intergenic region sequences. All FASTA hits with up to 3 mismatches are annotated as putative regulatory sRNA candidates on the basis of phylogenetic conservation. Further FASTA analysis allowing for up to 3 mismatches is performed against rice, *Brassica* and *Populus* genome datasets to confirm conserved sRNA. Identified conserved sequences are further analyzed by an RNA-folding program, leading to identification of candidates with a potential fold-back precursor structure that contains the sRNA sequence within one arm of the hairpin.

sRNA candidates are then identified from the cucurbit sRNA database based on differential expression of sRNA across the floral transition, as determined by both in silico and transcriptional profiling of phloem sap sRNA by Northern/reverse Northern methods, carried out as described below.

sRNA candidates are also identified from small RNA libraries of other species, such as *Arabidopsis*. These candidates are then tested in plants for their effects on flowering time (see Example 5 below)

Northern Analysis

Low molecular weight RNA is extracted from phloem of vegetative and flowering plants as described in Example 4, resolved on denaturing 15% polyacrylamide gel, blotted onto Hybond XL membrane (Amersham) and UV cross-linked. DNA oligonucleotides complementary to sRNA sequences are labeled and hybridized to RNA blots overnight at 40–45° C. in a solution containing 0.5 M $Na_2HPO_4$, 1 mM EDTA, 1% BSA, and 7% SDS. Blots are washed twice for 10 min in 2×SSC, 0.1% SDS at 50–55° C. Sense DNA oligonucleotides are used as negative control.

Reverse Northern Analysis

DNA oligonucleotides (1–100 pmol) complementary to sRNA are arrayed onto Hybond N+ membrane (Amersham) and fixed by baking or UV cross-linking. Vegetative and flowering plant phloem sRNA fractions, isolated and recovered from the gel as described in Example 4 are labeled. Vegetative and flowering probes of equal specific activity are hybridized to oligo arrays to identify differentially expressed sRNAs. Array of sense DNA oligonucleotides is used as a control.

(2). Bioinformatics Identification of Small RNA Target Genes

FASTA analysis with conserved candidate small RNAs and reverse complement of conserved candidate small RNAs is performed against the following target datasets: *Arabidopsis* CDS, *Arabidopsis* 3'UTR, *Arabidopsis* 5'UTR, Rice CDS and Genesis plant consensi sets in SRS (*Actinidia* spp, *Cucurbita* spp, *Eucalyptus* spp, *Festuca* spp, *Lolium* spp, *Malus domestica*, *Pinus radiata*, PinusTaedaAll, *Populus* spp assembled ESTs, Sicyos angulatus and *Vaccinium* spp). Reverse complement hits with up to 3 mismatches are reported as putative targets. Targets conserved across taxonomic boundaries are confirmed using RNA ligase mediated 5' RACE as described by Kasschau et al., *Dev. Cell* 4:205–217 (2003).

This approach is illustrated in the Table below for sequences identified herein as SEQ ID Nos. 251–263 and 383.

TABLE 3 miRNA sources and sequence annotation

| SEQ ID NO. | Source | Sequence annotation | Target family |
|---|---|---|---|
| 251 | Flowering *S. angulatus* phloem sap | miR156 | Squamosa-promoter binding protein |
| 252 | Vegetative *S. angulatus* phloem sap | miR159 | MYB transcription factors |
| 253 | Flowering *S. angulatus* phloem sap | Similar to miR159 | MYB transcription factors |

TABLE 3-continued miRNA sources and sequence annotation

| SEQ ID NO. | Source | Sequence annotation | Target family |
|---|---|---|---|
| 254 | Vegetative *C. moschata* phloem sap | Similar to miR159 | MYB transcription factors |
| 255 | Vegetative *S. angulatus* phloem sap | miR319a | TCP genes |
| 256 | Vegetative *S. angulatus* phloem sap | Similar to miR159 | MYB transcription factors |
| 257 | Flowering *C. sativus* Beluga phloem sap | miR162 | Dicer |
| 258 | Flowering *S. angulatus* phloem sap | Similar to miR167 | Auxin response factors |
| 259 | Vegetative *S. angulatus* phloem sap | Similar to miR167 | Auxin response factors |
| 260 | Flowering *S. angulatus* phloem sap | Similar to miR167 | Auxin response factors |
| 261 | Flowering *S. angulatus* phloem sap | Similar to miR167 | Auxin response factors |
| 262 | Flowering long day *C. moschata* phloem sap | Similar to miR169 | CCAAT binding transcription factors |
| 263 | Vegetative *S. angulatus* phloem sap | 172b | APETALA2-like transcription factors |
| 383 | *Arabidopsis thaliana* seedling (4–5 days old) | Similar to miR158 | At1g64100, unknown protein |

Table Legend:

miR319a: TTGGACTGAAGGGAGCTCCC (SEQ ID NO: 264)

Palatnik J F, Allen E, Wu X, Schommer C, Schwab R, Carrington J C, Weigel D. Control of leaf morphogenesis by microRNAs. *Nature* (2003) 425:257–263;

miR172: TTGGACTGAAGGGAGCTCCC (SEQ ID NO: 265)

Chen X. A MicroRNA as a Translational Repressor of APETALA2 in *Arabidopsis* Flower Development. *Science* 303:2022–2025 (2004); Published online Jul. 31, 2003;

miR156: TGACAGAAGAGAGTGAGCAC (SEQ ID NO: 266)

miR167: TGAAGCTGCCAGCATGATCTA (SEQ ID NO: 267)

Reinhart B J, Weinstein E G, Rhoades M W, Bartel B, Bartel D P. MicroRNAs in plants. *Genes Dev.* (2002) 16:1616–1626. Erratum in: *Genes Dev.* (2002) 16:213; and Kasschau K D, Xie Z, Allen E, Llave C, Chapman E J, Krizan K A, Carrington J C. P1/HC-Pro, a viral suppressor of RNA silencing, interferes with *Arabidopsis* development and mRNA function. *Dev. Cell* (2003) 4:205–217.

miR159: TTTGGATTGAAGGGAGCTCTA (SEQ ID NO: 268)

miR169: CAGCCAAGGATGACTTGCCGA (SEQ ID NO: 269)

Reinhart B J, Weinstein E G, Rhoades M W, Bartel B, Bartel D P. MicroRNAs in plants.

*Genes Dev.* (2002) 16:1616–1626. Erratum in: *Genes Dev.* (2002) 16:2313; and

Rhoades M W, Reinhart B J, Lim L P, Burge C B, Bartel B, Bartel D P. Prediction of plant microRNA targets. *Cell* (2002) 110:513–520.

miR162: TCGATAAACCTCTGCATCCAG (SEQ ID NO: 270)

Reinhart B J, Weinstein E G, Rhoades M W, Bartel B, Bartel D P. MicroRNAs in plants.

*Genes Dev.* (2002) 16:1616–1626. Erratum in: *Genes Dev.* (2002) 16:2313; and

Xie Z, Kasschau K D, Carrington J C. Negative Feedback Regulation of Dicer-Likel in *Arabidopsis* by microRNA-Guided mRNA Degradation. *Curr. Biol.* (2003) 13:784–789.

miR158: TCCCAAATGTAGACAAAGCA (SEQ ID NO: 383)

Rhoades M W, Reinhart B J, Lim L P, Burge C B, Bartel B, Bartel D P. Prediction of plant microRNA targets. *Cell* 110:513–520, 2002.

(3). Use of Macroarrays to identify Small RNA Targets

This method utilizes an array containing DNA of putative sRNA targets (eg transcription factors, chromatin remodelling genes) identified in phloem sap or tissue cDNA libraries. Plasmid DNA (10–100 ng) is arrayed onto Hybond N+ membrane (Amersham), denatured and fixed by baking or UV cross-linking. The phloem sRNA fraction is isolated and recovered from the gel (Example 4) and is labeled. The labeled sRNA is hybridized to the plasmid DNA array overnight at 30° C. in a solution containing 0.5 M $Na_2HPO_4$, 1 mM EDTA, 1% BSA, and 7% SDS. Blots are washed twice for 10 min in 2×SSC, 0.1% SDS at 37° C. Higher stringency washes are used if required and signal is captured using a phosphorimager.

F. In Planta Candidate Gene Analysis

Once a candidate LDFSC is identified, the encoding polynucleotide sequence is analyzed for its effect on flowering by transforming a plant with a genetic construct comprising the isolated sequence operably linked to a promoter and terminator and expressing the sequence in the plant. See Examples 6–8 below. The test plant may be the same as or different from the plant that normally expresses the sequence. For example, a late flowering cucurbit may be used to test candidate LDFSCs from other cucurbits of the same or different species. If transgenic expression of a candidate LDFSC produces flowering under non-inductive conditions, it is reasonable to infer that the candidate molecule is a florigen, or a component thereof. Alternatively, an early flowering cucurbit may be used to test candidate LDFSCs from other cucurbits of the same or different species. If transgenic expression of a candidate LDFSC suppresses or delays flowering under inductive conditions, it is reasonable to infer that the candidate molecule comprises a component of flowering control.

The inventors have developed methods for transforming cucumber plants (e.g., *C. sativus* cv Straight Eight). GUS staining of F0 primary cucumber transformants was performed to confirm expression of the transgene. The seed from the primary transgenics was harvested and germinated. Following germination, histochemical analysis of seedlings revealed meiotic transmission of the transgene with the expected Mendelian ratio of 3:1.

Candidate genes are selected for in planta analysis both from cucurbits and from *Arabidopsis*. *Arabidopsis* orthologs of cucurbit genes are identified as follows.

BLASTX is performed using the cucurbit candidate consensus nucleotide sequence (using default BLASTX parameters) to identify the *Arabidopsis* ortholog from the TAIR *Arabidopsis* peptide database (May 2003). TBLASTN (using default parameters) is then performed using the suspected *Arabidopsis* ortholog peptide sequence to determine if the top reciprocal hit is the original cucurbit consensus sequence. A phylogenetic tree is assembled (using CLUSTALX version 1.8 software, with 1000 bootstrap trials) for each consensus sequence, and the cucurbit candidate peptide sequence and the putative *Arabidopsis* ortholog peptide sequence(s) are compared in the resulting tree. The phylogenetic tree is used in conjunction with visual inspection of the BLASTX sequence alignments to select the best matching putative ortholog or corresponding gene among the *Arabidopsis* genes.

(1). Overexpression of *Arabidopsis* Candidate Genes in Phloem Using a Companion Cell-Specific Promoter The candidate cucurbit gene or *Arabidopsis* ortholog open reading frames (ATG to STOP codon) are amplified by the polymerase chain reaction from *Arabidopsis* cDNA or genomic DNA using gene specific primers with cloning sites (BamHI, ClaI, HindIII or SpeI). The amplified fragments are then restriction digested and cloned into a vector containing the *Arabidopsis* PP1 companion cell specific promoter and NOS terminator (An exemplary vector is shown in FIG. 49). Once the sequence is confirmed, the promoter-candidate gene-terminator cassette is cloned into the binary vector pART27 using NotI sites.

Candidate binary constructs are transformed into *Agrobacterium*. Confirmed kanamycin resistant *Agrobacterium* are used to transform *Arabidopsis thaliana* Col. Plants by a floral dipping procedure. Transgenic T1 plants are selected based on kanamycin resistance and homozygous transgenic lines selected in the T2 generation. Homozygous lines are used to phenotype significant changes in flowering time under controlled long and short day light conditions.

(2). Promoter::GUS Mediated Analysis of Candidate Gene Expression Pattern in *Arabidopsis*

In order to provide information on the expression patterns of candidate genes in *Arabidopsis*, the corresponding promoter of the candidate gene (a 1.5 kb genomic region upstream of the ATG) is cloned and fused upstream of the GUS marker gene. The promoter::GUS construct is then transformed into *Arabidopsis thaliana* Col. plants and the GUS expression pattern determined in T2 homozygous plants at vegetative and flowering developmental stages. Correlative evidence supporting non-cell autonomous action of the candidate gene would include floral induction (or delay) and expression in the leaves but not the shoot apex.

(3). Analysis of *Arabidopsis* T-DNA Insertion Lines for Candidate Genes

To complement the candidate gene overexpression studies detailed above, downregulation in *Arabidopsis* is studied using SALK T-DNA insertion lines obtained from the NASC Center, Nottingham, UK. A T-DNA line is selected based on T-DNA insertion into the *Arabidopsis* candidate gene.

Segregating T3 seed lines obtained from the NASC seed stock center are then screened for significant changes in flowering time by germination of seed on Grodan rockwool blocks soaked in nutrient mix and pricking out of seedlings onto fresh blocks. Flowering time is compared to wild type and known flowering marker lines grown next to the candidate lines. Both candidate and marker lines are grown under controlled short and long day light conditions as detailed below in Example 1D.

(4). Analysis of Candidate Genes by Engineered Dominant Negative Forms and Analysis of Flowering Time in *Arabidopsis* Companion Cell Overexpression Transgenic Lines Candidate transcription factors that demonstrate an alteration in flowering time following overexpression and/or downregulation in *Arabidopsis* or cucurbits will be engineered into dominant negative forms. In this instance, transcription factor candidates will be C-terminally translationally fused to the *Arabidopsis thaliana* EAR motif, a 12 amino acid repression domain that results in dominant repression of downstream target genes of the modified candidate (Hiratsu et at, (2003) *Plant J.* 34: 733–739). This dominant-negative approach can be used to achieve down regulation of gene families. In this way, the function of a putative flowering control transcription factor can be blocked and its effect on flowering time observed in transgenic plants overexpressing the fusion gene with a companion cell specific promoter, as described above.

In other instances, inspection of candidate sequences will suggest ways of manipulating these sequences into dominant negative forms, e.g., changes in essential amino acids, removal of RNA binding domains, and so on. These modified sequences will be tested for dominant negative effects.

(5). Analysis of Candidate Genes by Temporal Expression in *Arabidopsis* Companion Cell Overexpression Transgenic Lines In addition to constitutive overexpression of candidate genes in *Arabidopsis* using a companion cell-specific promoter, it is possible to achieve temporal expression of a candidate gene using a chemically inducible gene switch system, such as the ethanol inducible alc gene switch system which has been characterized in *Arabidopsis* (see Roslan et al., (2001) *Plant J.* 28:225–235). Such a system would comprise an activation cassette consisting of a companion cell specific promoter driving expression of an inducible activator transcription factor and a reporter cassette consisting of promoter binding elements of the activation transcription factor fused to a minimal promoter driving expression of the candidate gene. Both activation and reporter cassettes would be cloned on a binary plasmid to enable *Agrobacterium* mediated plant transformation.

Transgenic *Arabidopsis* plants containing the inducible system are exposed to a chemical inducer at a particular stage of development, which causes a conformational change in the structure of the companion cell-expressed activation transcription factor that allows it to bind to its promoter binding elements in the reporter cassette thus driving the expression of the candidate gene. In this way, temporal companion cell-specific expression of the candidate gene can be achieved. Such induced transgenic *Arabidopsis* lines are grown under controlled short and long day light conditions and phenotyped for significant changes in the flowering response.

(6). Viral Vector Mediated in Planta Candidate Gene Analysis

In planta candidate gene analysis is performed, in part, utilizing a plant viral vector delivery system. The vector derived from Zucchini yellow mosaic potyvirus (ZYMV) is used to deliver and mediate expression of candidate genes in the phloem-associated cells of *Sicyos angulatus* or *Cucurbita moschata* PI441726 maintained under non-inductive conditions. The viral vector was originally developed by the lab of Shyi-Dong Yeh from the Department of Plant Pathology of the National Chung Hsing University in Taichung, Taiwan (*Bot. Bull. Acad. Sin.* 2002, 43:261).

The potyvirus group (including ZYMV) contain a single-stranded positive sense RNA molecule of 8–10 kb. The genome of the ZYMV is translated into a single polypeptide of 350 kDa which is subsequently cleaved by the viral protease into 10 proteins essential for the virus infectious cycle. To overexpress the candidate gene, the coding sequence of the candidate is introduced into the genome of the virus as a translational fusion bordered by the viral protease cleavage site. Two variants of ZYMV will be used for overexpression of candidate genes. In the first variant, the site of the candidate gene insertion is located between proteins 9 and 10 (Nib and CP), while in the second variant, the insertion is between protein 1 and 2 (P1 and HC-Pro).

In both vectors, the site of insertion is followed by sequences encoding the cleavage site recognized by the Nia viral protease (protein 8). The presence of an additional protease recognition site upstream ensures that the inserted protein is released from the polyprotein albeit with N-terminal and C-terminal amino acid extension by the Nia protease. During the infection process the expressed candidate sequence is released in the cytoplasm of the infected cell. The capacity of ZYMV to move cell to cell and systemically within the plant ensures release of the candidate protein in cells throughout the infection process. Using this viral vector delivery system, we have demonstrated that cucurbit CO and FT induce flowering when expressed in the *Cucurbita moschata* PI 441726 system (See FIGS. 147 and 148, and Example 6 below). We anticipate that this viral vector delivery system with *Sicyos angulatus* and/or *Cucurbita moschata* PI 441726 maintained under non-inductive conditions will reveal additional candidates that induce flowering. Experiments are currently underway in our laboratory to ascertain whether SIPs such as those encoded by polynucleotide sequences identified herein as SEQ ID Nos. 271–323 are active in florigenic signaling.

Other experiments in progress are designed to identify functional regions of the FT polypeptide that are involved in one or more aspects of floral control.

In these experiments, peptides of 3–27 amino acids are derived from the FT N-terminus and tested for their ability to induce flowering (FIG. 149). Parallel experiments will be performed to reveal genes that suppress or delay flowering when the plants are maintained under inductive conditions. The polynucleotide sequences encoding these peptides are given in SEQ ID NOS: 405–482 (*A. thaliana*), SEQ ID NOS: 561–638 (*Cucurbita maxima*), and SEQ ID NOS: 717–794 (*Festuca arundinacea*). The sequences of the peptides are given in SEQ ID NOS: 483–560 (*A. thaliana*), SEQ ID NOS: 639–716 (*Cucurbita maxima*), and SEQ ID NOS: 795–872 (*Festuca arundinacea*).

2. Methods of Modulating the Florigenic Signaling Pathway

In another of its aspects, the present invention provides methods for modulating the florigenic signaling pathway to modify the occurrence, timing and extent of flower development.

The phrase "modulating the florigenic signaling pathway" means altering one or more steps in the above-described florigenic signaling pathway to effect either positive or negative changes in flower induction. The one or more modulatable steps in the pathway include: the reception and transduction of a signal from a leaf sensor cell by a CC in the leaf; the process of rendering the signal transmissible; the controlled entry of the LDFCS into the phloem; the translocation of the LDFCS in the phloem (including regeneration and amplification steps); the delivery of the signal to the target meristem tissue (including any transformations of the signal that may be required for egress or propagation of the signal from the terminal phloem).

A. Modulation of Endogenous Gene Transcription Using Agonists or Antagonists

The transcription of genes, identified as described above, which are involved in the production or delivery of an LDFSC, can be modulated by an agonist or antagonist of a binding event between a signaling molecule and its cognate binding partner that initiates the florigenic signaling cascade in the CC cells. The agonist or antagonist acts at the binding step or downstream of it, e.g., at a site in the signal transduction pathway, to increase or decrease gene transcription. The modulatable binding event may occur anywhere in or on the cell. For example, the binding interaction may occur inside the cell or at its surface or beneath the cell surface, in the cytosol, in a subcellular membrane or organelle, e.g., the nucleus.

The binding molecule may act as a transcription factor for one or more genes in the florigenic signaling cascade. In this case, the agonist (or antagonist) may interact with the transcription factor and/or other endogenous transcription complex proteins, or with a polynucleotide regulatory sequence, to enhance (or inhibit) transcription. If transcription is normally repressed, the agonist may bind a repressor molecule or a cis-element of a regulatory region to relieve repression. Alternatively, the agonist (or antagonist) may be a polynucleotide sequence that is used as a decoy to bind (i.e., to titrate) a repressor (or transcription) factor.

The agonist or antagonist may be isolated from a natural source or produced by synthetic or recombinant techniques. Exemplary agonists/antagonists include proteins, peptides, RNAs, naturally-occurring or synthetic molecules/complexes, and combinations thereof. Further modification is also contemplated, e.g., post-translational modification of a protein or modification of one or more components of a complex of any of the aforementioned constituents. Antibodies or their derivatives (e.g., single chain antibody fragment(s) [ScFv], anti-idiotypic antibodies) that directly or indirectly modify the activity of the LDFSC or LDFSC component(s) are also useful agonists and antagonists and can be expressed in plants if desired.

Depending on the biochemical nature of the agonist or antagonist, the latter may be introduced into the plant by, for example, wick feeding directly into the vasculature, physical contact (e.g., rubbing) of agonist or antagonist in the presence of absence of compounds (e.g., surfactants) that facilitate penetration into plant tissues, use of an engineered RNA transporter (ERT) that is transported between cells by a defined protein machinery provided in trans to deliver a defined agonist or antagonist in the presence or absence of a virus (Lough, Emerson, Lee, Forster and Lucas, unpublished data)), use of a modified ERT that encodes both the transporting proteins and the transported agonist or antagonist, grafting techniques (e.g., bark grafting) for diffusible agonists or antagonists, *Agrobacterium tumefaciens* or biolistic bombardment mediated transient expression resulting in the local production of an agonist or antagonist, use of viral vectors (e.g., based on tobamoviruses, potexviruses or tobraviruses) to deliver the agonist or antagonist, and the like.

B. Modulation by Introducing a Recombinant Gene that Encodes an LDFSC or LDFSC Component A genetic construct comprising one or more polynucleotide sequences that encode a candidate LDFSC or LDFSC accessory component can be introduced into a plant to determine the effect of expressing the sequence on floral induction. Ectopic expression can be used for validating the involvement of an endogenous gene in the florigenic signaling pathway and for determining the interchangeability of a candidate LDFSC or LDFSC component(s) that is derived from one plant species in the florigenic cascade of a different plant species.

The present invention contemplates the use of sense constructs to upregulate gene expression (either directly or by co-suppression of repressor genes). Genetic constructs comprising partial or full-length sequences can also be used to downregulate or silence the expression of repressor genes that affect the competency to flower, or to reduce the expression of florigenic signaling genes. RNAi methods and antisense technology are well known to those skilled in the art and can be used to selectively reduce or eliminate gene expression. RNAi reduces or eliminates specific gene functions by targeting for degradation the transcription products of genes with dsRNA homologous to the introduced sequence (reviewed by Sharp, *Genes Dev.* 13: 139–41 (1999)). RNAi can be produced by introducing double-stranded or single stranded RNA into plant cells, or by transforming the plants with RNAi expression constructs. The use of VIGS that can controllably and efficiently reduce gene expression in a systemic manner provides an alternative means for modulating the extent and timing of flowering. RNA virus vectors have also been described in connection with PTGS. Representative examples of RNAi silencing methods can be found in the following patent applications and publications: PCT Applications WO 99/49029, WO 98/36083, WO 99/15682, WO 98/53083, WO 99/53050, WO 00/49035, WO 01/77350, WO01/94603, WO02/00894, WO01/75164, and WO01/68836; Waterhouse et al., *Proc. Natl. Acad. Sci. USA* 95: 13959–13964 (1998); Smith et al., *Nature* 407: 319–320 (2000), Ruiz et al., *Plant Cell* 10: 937–946 (1998).

The above-described constructs utilize promoters that are expressed in many cell types (e.g., CaMV, 35S, superubiquitin), or promoters that are tissue specific and/or inducible. In a preferred embodiment of the invention, CC-specific promoters are used (e.g., the promoters for AtSut1, AtSUC2 (Genbank accession X79702), rolC, C. melo GAS1 (Genbank accession AF249912), AtPP16K (Genbank accession ATT22E16), AtPP1 (Genbank accession AL161544, AtPP2 (Genbank accession AL161551), AtLEAFY (Genbank accession M91208), and others.

Examples of inducible promoters include, for example, ethanol (Caddick et al., *Nature Biotech.* 16:177–180 (1998)), copper (Mett et al., *Proc. Natl. Acad. Sci. USA* 90: 4567–4571 (1993)), ecdysone (Martinez et al., *Plant J.* 19:97–106 (1999) and others. Many plant promoters are known that can be used for practicing this invention.

Stably transformed plants expressing an LDFSC or LDFSC component can be obtained using *Agrobacterium tumefaciens* or microprojectile bombardment transformation procedures. These and other plant transformation methods are disclosed in this application and are well known to plant biotechnologists.

C. Modulation of Flowering by Use of a Covalently Modified LDFSC

A florigenic signal that is taken up by, or produced within, the CC may require covalent modification(s) for entry into the phloem, for delivery to meristematic target tissue, and/or for activity at the target site. For example, a florigenic inducer that is produced elsewhere and taken up by the CC may contain additional amino acid residues/sequences (i.e. signal motifs/sequences) that direct its retention in CC cells. The cleavage of such sequences may be required for release from sites within the CC for subsequent transport into the SE. Alternatively, for entry into the phloem, a florigenic inducer may require modification, for instance, post-translational modification such as phosphorylation, glycosylation, or cleavage of amino acids, or by removal or addition of nucleotides as a result of alternative splicing (see, e.g., Lopato et al., *Genes Dev.* 13:987–1001 (1999)).

The identification of relevant modifications is made by correlating data from phloem sap analysis with sequence databases (prepared as described above). For example, phloem mobile peptides that originate from propeptide precursors or CC retention signals that require removal prior to translocation of a protein into the sieve tube system are identified by correlating mass fingerprinting and fragment analysis of phloem-mobile peptides and proteins with database sequences. Comparisons between phloem-mobile gene products predicted from the vascular gene database and phloem-mobile gene products defined by direct analysis are expected to yield information about potential targeting sequences, motifs and CC retention signals. In addition, comparison of phloem mobile RNAs, peptides and proteins may uncover common cis-acting zip code sequences and phloem-targeting sequences. Post-translational modifications may be detected by selective enrichment of post-translationally modified proteins from crude extracts using affinity-based methods (e.g., lectins for glycosylated proteins, high-affinity antibodies for phosphotyrosinyl residues, Pandey et al., *Proc. Natl. Acad. Sci. USA* 97:179–184 (2000)) or biotin affinity labels for phosphoseryl/phosphothreonyl residues (see Oda et al., *Nature Biotech.* 79:379–382 (2001)) combined with mass fingerprinting and fragmentation analyses (See, e.g., Zhou et al., *Nature Biotech.* 79:375–378 (2001)).

Putative retention signals, motifs or signal sequences identified by the above procedures can be translationally fused to a reporter molecule to ascertain the effect of the modification (e.g., selective retention or gain of function). The resulting information is useful in the design of fusion genes for modulating flowering when introduced into a plant.

The effect of other posttranslational modifications on a florigenic signaling protein, such as phosphorylation, isoprenylation, glycosylation, conjugation to small molecules and others, may be investigated, for example, by targeting specific cellular enzymes/enzyme cascades that catalyze the modifications, by changing the availability of substrates or cofactors, or by altering the amino acid sequence of a florigenic signaling protein.

D. Modulation of Delivery of an LDFSC to the Target Meristematic Tissue

The spatial and temporal characteristics of flowering can be modulated by affecting one or more of the following processes involved in the delivery of an LDFSC to the target meristem: the entry of the LDFSC into the phloem; the translocation of the LDFSC from the point of entry to the point of delivery in the terminal phloem; and the delivery of the signal to the target tissue.

The entry of the LDFSC into the phloem can be modulated by changing one or more of the following: the molecular dimensions of the LDFSC, the plasmodesmal SEL; or the translocation machinery within the plasmodesmata (PD).

Conformational changes in a protein or ribonucleoprotein LDFSC may involve a specific chaperone or receptor molecule within the PD that recognizes, binds and unfolds the protein. See, e.g., Kragler et al., *EMBO J.* 19:2856–2868 (2000). The binding of the chaperone to the LDFSC or to a binding site within the PD may be altered by modifying the binding properties of the chaperone directly, by changing its structure, or indirectly with agonists or antagonists of binding. Methods involving the use of viral and plant movement proteins to mediate cell-to-cell transport can be used in the practice of the present invention. Such methods are described in PCT/US96/13299 and PCT/US96/19260, which are incorporated by reference herein in their entirety.

Changes in the plasmodesmal. SEL, e.g., dilation or constriction of the PD aperture, may be produced by changes in the organization or contractility of filamentous actin, actomyosin or centrin brought about, e.g., by changes in calcium levels or phosphorylation-dephosphorylation. (See e.g., Zambryski and Crawford, *Ann. Rev. Cell Dev. Biol.* 16:393–421 (2000)). Modulation of calcium release and sequestration by Ca++ binding proteins in PD, of cell wall protein kinases and/or phosphatases, the introduction of actin-disrupting or stabilizing agents and/or modifications in myosin or centrin may alter the movement of materials through the PD.

Vectorial translocation of macromolecules through the PD may be effected by molecular motors (e.g., microtubulebased kinesin motors or actin-based myosin motors) (see Vale and Milligan, *Science* 288:88–95 (2000); Mermall et al., *Science* 279:527–533 (1998)), filament- and tubule-based springs, and by polymerization-induced growth (Mahadevan and Matsudaira, *Science* 288:95–99 (2000)). Changes in actomyosin and actin organization described above are expected to affect translocation as well.

The egress of the LDFSC from the terminal phloem may require additional modifications. For example, the removal of retention signals or a change in the size or conformation of LDFSC may be required to allow movement of the LDFSC from the phloem into the target site. If the LDFSC moves via symplastic transport, the extent and/or rate of movement may be influenced by the number and/or structure of functionally active PD at the apex (Ormenese et al., *Planta* 211:370–375 (2000)). As well, the delivery route may be dependent upon the presence of address signals on the LDFSC that can be recognized by the transporting channels. Alternatively, if the LDFSC is communicated by a relay mechanism, the relay may require regeneration of the original signal or its conversion to a different form that can be propagated to, and received and transduced by, target meristem cells. One or more of these processes may be susceptible to modification to modulate a flowering response.

In general, it is understood that modulators of the flowering response may be components of other pathways that use both local and systemic transport of signals, e.g., stress-activated responses, viral infection and immunity, etc. and that modulators may be interchangeable between different species of plants.

The ability to modulate the amount of an LDFSC produced in response to an external stimulus may also be useful, e.g., to determine the stability of an LDFSC, to determine the relationship between the amount of LDFSC produced and the rate of progression to flowering (see, e.g., Pouteau et al., *Plant Physiol.* 118:1191–1201 (1998)) and to identify cell types involved in the regeneration or amplification of LDFSC during systemic transport. Modulation may be effected by changing the duration of exposure of a plant to an external stimulus, or the total portion of the plant exposed to the stimulus (e.g., the number of induced leaves on the plant, Tooke and Battey, *Plant Cell* 12:1837–1848 (2000)).

The amount and position of flowers that form on a plant may be modulated by altering the responsiveness of axillary meristem to flower inducing signals, e.g., by interfering with repressors of flowering or by facilitating the transport of inducers to axillary meristems.

3. Methods of Screening for Modulators of the Florigenic Signaling Pathway

The present invention comprises various methods of screening for modulators of the florigenic signaling pathway. In the broadest aspect, these methods comprise the following steps:

exposing a plant (or a portion thereof) to a flowering stimulus;

contacting the plant (or portion thereof) with a candidate modulator; and assessing the effect of the candidate modulator on florigenic signaling.

A "flowering stimulus" is any stimulus that is capable of inducing the florigenic signaling cascade, e.g., a photoperiod, a stress response, an artificial stimulus or a natural stimulus. A plant (or portion thereof) used for screening may be exposed to the signal directly or indirectly, e.g., via a heterograft that has been stimulated.

"Contacting" may be by any means, including direct surface application to an intact or cut portion of the plant, microinjection into a tissue or cell thereof, microbombardment, preferably under low pressure, etc.

The effect of the candidate modulator on florigenic signaling involves comparing a stimulus-dependent biochemical, functional, cytological or morphological change in the plant in the presence and absence of the candidate modulator. This change may involve, e.g., the production or inhibition of an inflorescence meristem or flower, a change in mitotic activity in shoot apical or lateral meristem cells, a change in symplastic transport of reporter-tagged macromolecules between cells in the meristem, the appearance of one or more unique transcripts or gene products in a portion of the plant involved in the generation, transmission or reception of a florigenic inducing signal (e.g., leaf cells or vasculature, stem vascular tissues, phloem sap, shoot apex), the activation of a genetic construct in a transformed plant cell, and other changes that are indicative of, or may correlate with florigenic signaling.

In vitro binding assays are also used according to the invention to identify agents that are capable of modulating the florigenic signaling pathway, e.g., by affecting the binding of an LDFSC to an LDFSC accessory component, an LDFSC to an LDFSC receptor in a target tissue or an LDFSC to a polynucleotide involved florigenic signaling.

Uses of this Invention:

The present invention provides methods for identifying an LDFSC and other components of the florigenic signaling pathway and for modulating floral development in a wide variety of plant species. These methods can be practiced by those of ordinary skill in the art, without undue experimentation, using currently available techniques that are routinely used in biotechnology and are referenced herein.

The identification of an LDFSC and other components of the florigenic signaling pathway is a prerequisite for the development of modified plants that display accelerated or delayed flowering responses compared with unmodified native plants. Such plant modifications have substantial practical uses, including for example: synchronization of floral induction in ornamental flowering plants and mechanical harvested crops such as peas to ensure that the produce obtained from all of the plants is uniform; suppression of florigenic signaling to delay or abolish flowering in instances where flowering lowers the value of the harvested crop (e.g., onion, celery, cabbage and other vegetables that bolt); selective induction of either male or female flowers when these flowers are normally derived from separate meristems; induction of male sterility by suppression of florigenic signaling that otherwise would lead to induction of male flowers or flower parts; acceleration of flowering time to lessen the time required to collect seed; acceleration of flowering time to enhance quality (e.g., in wine grapes); enhance reproductive to vegetative ratio in evergreen fruit crops such as kiwifruit and avocados; use of a florigenic activator to synchronize bud burst, e.g., in New Zealand kiwifruit (*Actinidia* spp.), table grapes, and for other applications where an agrichemical spray such as hydrogen cyanamide is presently used for this purpose.

Key floral integrators coordinate the initiation of flowering. We have shown that both the *Arabidopsis* Flowering locus T (FT) and the pumpkin ortholog of FT promoted flowering via the phloem. FT and other flowering control genes acting in the phloem will serve as targets for the rational design of "drugs". Crystallographic data and molecular modeling will be used to design small molecule "drugs" to specifically interact with identified targets. The drugs are then synthesized and tested for their ability to interact with the target, using binding assays. Preferably, these drugs pass through the barriers of the leaf, e.g. the cuticle, when sprayed onto the leaf, and act systemically to modify and control the flowering response of the plant. The candidate drugs are then tested in plants for the ability to act systemically and modify flowering. The capacity of a spray to promote flowering will be tested using *Arabidopsis* maintained under non-inductive short days. Positive controls will include transgenic plants ectopically expressing FT or plants photoperiodically induced to flower. Quantifying the effect will be achieved by recording the number of rosette leaves formed at time of bolting.

The capacity of the spray to suppress flowering will be tested using *Arabidopsis* induced to flower by long day treatment. Controls will include plants maintained under short day photoperiods. Quantifying the effect will be achieved by recording the number of rosette leaves formed at time of bolting. Additional evaluation systems are envisaged. For instance spray testing of lettuce plants maintained under inductive conditions (in this case >30° C.).

The following examples are presented solely to illustrate the practice of the invention, and not to limit the scope of the invention as claimed.

EXAMPLES

Example 1

Plant systems and Control of Floral Induction

This Example describes methods of controlling floral induction in plant systems used for identification and isolation of candidate flowering control genes from *Cucurbit* species and *Arabidopsis*.

A. *Sicyos angulatus*

*Sicyos angulatus* is grown in controlled environment chambers. Surface sterilized, imbibed, decoated seeds are germinated on a heated pad at 27° C. in vermiculite under constant light. Seedlings are transferred to Grodan rockwool blocks soaked in nutrient mix (recipe, CF values and pH available on request) and maintained as follows: 1) 26° C.; 2) 50% humidity and 3) an 8 hr light period with 16 hr dark period interspersed with red light night breaks. Currently these night breaks are of 5 min duration and occur every 60 min. Plants maintained in this manner remain vegetative without visible signs of floral bud development. When the plants are established and have grown ~8–10 nodes (usually 10–14 days) the temperature is altered and maintained at 15° C. until time for tissue/phloem sap collection. Flowering is induced by removal of the night breaks while maintaining an 8 hr light period.

Stages of flowering were assessed phenotypically as described by Takahashi et al., *Plant Cell Physiol.* 23:1–9 (1982). Flower initiation, sexuality and development of flowers on each node of the main shoot were observed. Many floral buds produced in the present experiments stopped development at various floral stages, and the final stages reached were recorded for each bud. Floral stages were determined by the longitudinal length for pistillate flowers and by the width for staminate flowers according to the following classification: 0, vegetative; 1, inflorescence primordium; 2, floral bud not exceeding 0.5 mm; 3, 0.6–1.5 mm; 4, 1.6–2.5 mm; 5, above 2.6 mm; 6, flower in anthesis.

B. *Cucurbita moschata*

100 different accessions of *Cucurbita moschata* were obtained from the seed stock center. These were phenotyped in a greenhouse to identify early and late flowering accessions. *Cucurbita moschata* PI212011 was identified as an accession that flowered readily under both long days and short days. We selected this as an early flowering accession and seed stocks were bulked up in the greenhouse. *Cucurbita moschata* PI441726 was identified as late flowering, and we have shown that this accession can be maintained in a vegetative state under long days. There is a temperature component to floral induction with this accession, as long day repression appears to be relaxed as the temperature rises. Phloem sap obtained is used for comparing the phloem mobile population of molecules in flowering and non-flowering plants.

C. Heterograft

We have determined that *Cucumis sativus* cv Straight 8 is an excellent source of floral stimulus, by showing that:

(a) when a Sicyos angulatus scion was grafted onto *Cucumis sativus* cv Straight 8, all plants were induced to flower, in contrast to the self grafted *Sicyos angulatus* controls, where none of the plants was induced to flower; and (b) when a *Cucurbita moschata* PI441726 scion was grafted onto *Cucumis sativus* cv Straight 8, all plants were induced to flower, in contrast to the self grafted *Cucurbita moschata* P1441726 controls, where none of the plants was induced to flower.

The *Cucumis sativus* cv Straight 8 (stock)/*Cucurbita moschata* P1441726 (scion) heterografted plants are maintained in a greenhouse. *Cucumis sativus* cv Straight 8 plants are germinated at 27° C. on a heated pad, then transferred to Grodan rockwool blocks and grown hydroponically. When the plants are 8–15 nodes in height they are grafted with a *Cucurbita moschata* PI441726 scion using a reciprocally cut V-shaped wedge graft. The graft union is physically held using aluminum foil, and humidity is maintained by placing a plastic bag over the top. The bag is removed 7–10 days later when the graft shows signs of active growth. As the plants continue to grow, ~100% of grafted scion show signs of floral induction. Buds appear and eventually flowers go to full anthesis. To maximize transport of phloem into the scion, and hence floral induction, we remove the leaves and wrap the scion in black paper, thereby manipulating the source to sink ratio. Phloem sap is collected from the scion either by removing the scion above the graft union and bleeding from the cut end or nicking the scion stem while still attached and collecting the exuding droplets.

D. *Arabidopsis*

Floral induction can be induced and synchronized by first vernalizing plants and then growing plants under short day conditions prior to a single long day floral induction. These procedures have been described and refined by the group of George Bernier (Corbesier et al., (1996), *Plant J.* 9:947–952; Jacqmard et al., (2003), *Ann. Bot.* (*Lond*). 91:571–576; Tocquin et al., (2003), *BMC Plant Biol.* 3:2). Plants are first vernalized for 42 days at 4° C. and then maintained under non-inductive short day conditions for 40–60 days. A single long day (e.g., a single intervening dark period is replaced with continuous light) is sufficient to induce synchronized flowering.

Candidate genes derived from the Genesis cucurbit phloem sap database (whether *Arabidopsis* orthologs or full length cucurbit candidate genes) are introduced into *Arabidopsis* Col. by a floral dip procedure under the control of a constitutive promoter (e.g. superubuiquitin promoter), a companion cell-specific promoter (e.g., the *Arabidopsis* PP1 promoter), another tissue specific promoter or an inducible promoter. Selection of primary transformants is performed using seeds sown on plates or directly onto rockwool containing kanamycin. Alternatively, homozygous T2 or T3 seed is pre-screened and collected. Seedlings are vernalized for 1–6 weeks at 4° C. in the dark and then transferred to SD growing condition (8 h light/16 h dark, 22° C., 60–65% humidity, and light levels of 50–200 $\mu mol\ m^{-2}s^{-1}$ for growth and synchronized induction. Floral induction is initiated using an uninterrupted long day light period.

The above procedure is used to determine the ability of flowering control candidate genes to induce *Arabidopsis* to flower under non-inductive SD conditions or to suppress or otherwise modify synchronized floral induction.

Example 2

Identification of Phloem-Mobile Transcripts

This Example illustrates the use of *C. sativus* (scion)/*C. maxima* (rootstock) to identify phloem-mobile pumpkin sequences represented in libraries constructed from RNA of heterografted plants.

1. Grafting Protocols

The side-grafting technique of Tiedemann, *Plant Physiol.* 134:427–440 (1989) was employed, with some modifications, to generate heterografts between scions cut from 4-week-old cucumber (*Cucumis sativus* cv. Straight Eight) plants (vegetative apex to the second expanded leaf) and stocks provided by equivalent-aged pumpkin plants. Each excised cucumber scion (approx. 5–10 cm in length) was carefully inserted into an incision made in a pumpkin (or cucumber for autografts) stem at a location 10 cm back from the vegetative apex. The graft site was fastened with tape or aluminium foil and sealed with a ziplock clear plastic bag. Grafted plants were grown in a greenhouse for 2–3 weeks. These conditions were optimized for the formation of functional graft unions. Plants were employed for phloem sap analysis 3–4 weeks after being grafted.

2. Phloem Sap Collection and RNA Extraction

Phloem sap was collected essentially as described by Ruiz-Medrano et al., *Development* 126:4405–4419 (1999) from *Cucurbita maxima*, *Cucurbita moschata* and *Cucumis sativus* plants and the grafted scions of *Cucumis sativus*. Stems or petioles were excised from the plant and blotted, twice, for several seconds onto sterile filter paper (#3 MM; Whatman, Maidstone, UK). Phloem sap exuded thereafter was collected using sterile micropipette tips (200 ml) and immediately mixed with an equal volume of 8 M guanidinium buffer (Logemann et al., *Anal. Biochem.* 163:16–20 (1987)) or phenol. Proteins in this sap were then extracted, twice, with a 25:24:1 phenol:chloroform:isoamyl alcohol mixture in the case of guanidinium buffer or chloroform in the case of phenol. The remaining RNA was then precipitated with 1.0 volume of isopropanol, 0.1 volumes of 3 M sodium acetate, pH 5.2 and 20 µg of a carrier such as linear acrylamide or glycogen, centrifuged at 4° C. for 45 minutes, washed with 70% ethanol, centrifuged at 4° C. for 30 minutes and then resuspended in sterilized deionized water.

Typically, RNA was extracted from 5–15 ml phloem sap of *Cucurbita maxima*, *Cucurbita moschata*, *Cucumis sativus* or heterografted plants. cDNAs were cloned from phloem sap RNA as described below in Examples 3 and 4. *Cucurbita maxima* (or *Cucurbita moschata*) and *Cucumis sativus* are taxonomically distinct species (Jobst et al., *Mol. Phylogenetics Evolution* 8:204–219 (1998)). This is reflected in sequence divergence and, as a consequence, comparative bioinformatic analysis of *Cucurbita*, *Cucumis* and heterograft phloem sap libraries provides a means of identifying phloem mobile pumpkin sequences represented in libraries constructed from RNA of heterografted plants.

Example 3

Cloning ESTs from Cucurbit Phloem Sap Poly (A)+ RNA

PolyA+ RNA was isolated from phloem sap using methods described by Ruiz-Medrano, *Development* 126: 4405–4419 (1999).

One methodology, APAC (Arbitrarily Primed Amplified cDNA) was developed to clone ESTs from cucurbit phloem sap. The APAC method relies on PCR and is used with up to 40 cycles of amplification.

APAC Method

Figure 50:
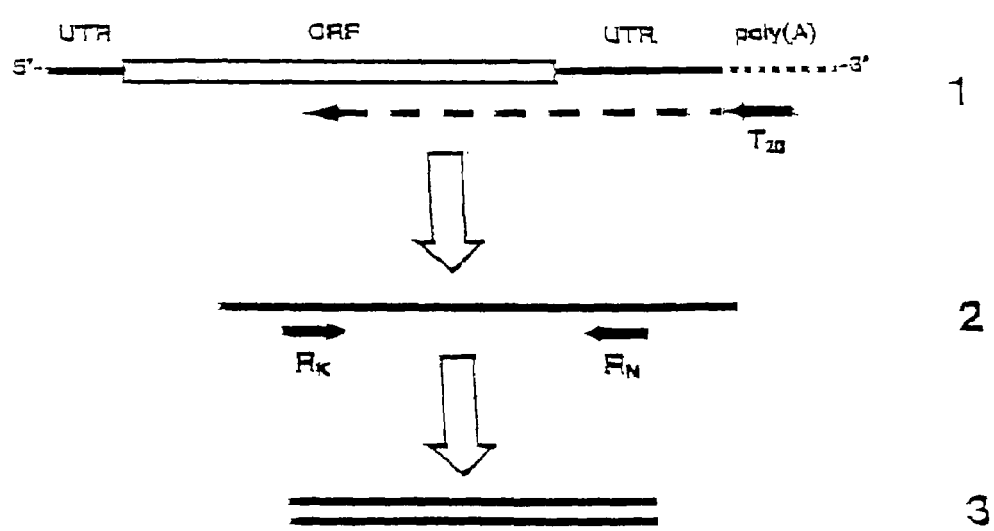
FIG. 50. Diagram illustrating Arbitrarily-Primed Amplified cDNA (APAC).

This method is illustrated in FIG. 50. In FIGS. 50-1, poly (A)+ RNA is reverse transcribed into first-strand cDNA by using a $T_{20}$ anchor primer. First-strand cDNA is subjected to PCR employing 45 different pairs of arbitrary decamer primers $R_K$ and $R_N$ to generate 45 expression windows (FIG. 50-2). Six different primer sets each comprising 10 arbitrary decamer primers (Arbitrary 10-mer Primer Kits for Fingerprinting and Genetic Mapping; Sigma-Aldrich Genosys, Australia) were used to generate Cucurbit phloem-specific cDNA libraries. The sequences of primer set 1 are shown in Table 1 below (SEQ ID NOS: 101–110) and as an illustration primer combinations used for second-strand cDNA synthesis using primer set 1 primers are shown below in Table 2. The resulting PCR products are double-stranded cDNA fragments with 3'-A overhangs ready for TOPO-TA™ (Invitrogen, Carlsbad, Calif.) cloning (FIG. 50-3).

TABLE 1

Sequences of the arbitrary decamer primers of set 1 used for the APAC methodology

| SEQ ID NO: | SET 1 Primers | Sequence |
| --- | --- | --- |
| 101 | R50-1 | GTGCAATGAG |
| 102 | R50-2 | CAATGCGTCT |
| 103 | R50-3 | AGGATACGTG |
| 104 | R50-4 | TCCCTTTAGC |
| 105 | R50-5 | CGGATAACTG |
| 106 | R50-6 | AGGTTCTAGC |
| 107 | R50-7 | TCCGACGTAT |
| 108 | R50-8 | GGAAGACAAC |
| 109 | R50-9 | AGAAGCGATG |
| 110 | R50-10 | CCATTTACGC |

TABLE 2

All possible 45 primer combinations used for second-strand cDNA synthesis in the APAC methodology.

| Mix No. | Primer 1 | Primer 2 |
| --- | --- | --- |
| A1 | R50-1 | R50-2 |
| A2 | R50-1 | R50-3 |
| A3 | R50-1 | R50-4 |
| A4 | R50-1 | R50-5 |
| A5 | R50-1 | R50-6 |
| A6 | R50-1 | R50-7 |
| A7 | R50-1 | R50-8 |
| A8 | R50-1 | R50-9 |
| A9 | R50-1 | R50-10 |
| A10 | R50-2 | R50-3 |
| A11 | R50-2 | R50-4 |
| A12 | R50-2 | R50-5 |
| A13 | R50-2 | R50-6 |
| A14 | R50-2 | R50-7 |
| A15 | R50-2 | R50-8 |
| A16 | R50-2 | R50-9 |
| A17 | R50-2 | R50-10 |
| A18 | R50-3 | R50-4 |
| A19 | R50-3 | R50-5 |
| A20 | R50-3 | R50-6 |
| A21 | R50-3 | R50-7 |
| A22 | R50-3 | R50-8 |
| A23 | R50-3 | R50-9 |
| A24 | R50-3 | R50-10 |
| A25 | R50-4 | R50-5 |
| A26 | R50-4 | R50-6 |
| A27 | R50-4 | R50-7 |

TABLE 2-continued

All possible 45 primer combinations used for second-strand cDNA synthesis in the APAC methodology.

| Mix No. | Primer 1 | Primer 2 |
|---------|----------|----------|
| A28 | R50-4 | R50-8 |
| A29 | R50-4 | R50-9 |
| A30 | R50-4 | R50-10 |
| A31 | R50-5 | R50-6 |
| A32 | R50-5 | R50-7 |
| A33 | R50-5 | R50-8 |
| A34 | R50-5 | R50-9 |
| A35 | R50-5 | R50-10 |
| A36 | R50-6 | R50-7 |
| A37 | R50-6 | R50-8 |
| A38 | R50-6 | R50-9 |
| A39 | R50-6 | R50-10 |
| A40 | R50-7 | R50-8 |
| A41 | R50-7 | R50-9 |
| A42 | R50-7 | R50-10 |
| A43 | R50-8 | R50-9 |
| A44 | R50-8 | R50-10 |
| A45 | R50-9 | R50-10 |

Example 4

Construction of Small RNA Libraries

Small RNA Collection from Phloem Sap

Phloem sap was collected according to methods described by Ruiz-Medrano, *Development* 126:4405–4419 (1999) and Yoo et al., *J. Biol. Chem.* 277:15325 (2002).

Purification of High and Low Molecular Weight RNA

High and low molecular weight fractions of RNA were prepared from total RNA using RNAqueous™ kit (Ambion, Austin Tex.). High molecular weight RNA was recovered from the glass fibre filter to which it binds in concentrated chaotropic salt solutions. Low molecular weight RNA was recovered from the flow-through and separated by electrophoresis through a denaturing 15% acrylamide gel. RNA in the 19–25 nt range (small RNA or sRNA) was excised from the gel and eluted with 0.5 M Na acetate, 10 mM EDTA at 4° C. overnight. The sRNA fraction was recovered by ethanol precipitation with 40 μg of glycogen and cloned.

Library Construction

Cloning Protocol 1 (Adapted from Elbashir et al., (2001) *EMBO J.* 20:6877–6888).

The sRNA sample, prepared as described above, was treated with Shrimp Alkaline Phosphate (SAP, Roche Diagnostics, Indianapolis Ind.), extracted with phenol/chloroform, and precipitated with ethanol. The dephosphorylated sRNA sample was ligated to the 3' RNA/DNA adapter ($PO_4$-UUUAACCGCATCCTTCTC-fluorescein), where UUU are ribonucleotides, (SEQ ID NO: 111) in 50 mM Tris-HCl, pH 7.6, 10 mM $MgCl_2$, 1 mM ATP, 1 mM DTT, 5% PEG 8000, 0.1 mg/ml BSA, with 50 U T4 RNA ligase at room temperature for 2–4 hours or at 5° C. overnight. The ligation product is recovered from the gel as described above and is 5' phosphorylated in 70 mM Tris-HCl pH 7.6, 10 mM $MgCl_2$, 100 mM KCl, 1 mM 2-mercaptoethanol, 1 mM ATP, with 10 U T4 polynucleotide kinase at 37° C. for 10 minutes. The phosphorylation reaction is stopped by phenol/chloroform extraction and RNA is recovered by ethanol precipitation. The 5' DNA/RNA adapter (Cy5-TACTAATAC-GACTCACTAAA), where AAA are ribonucleotides, (SEQ ID NO: 112) is then ligated to the phosphorylated ligation product as described above. A fluorescent 3' end block on the 3' adaptor and Cy5 on the 5' adaptor are useful for ease of monitoring the products dating synthesis. The new ligation product is extracted with phenol/chloroform, and precipitated with ethanol. This is followed by RT-PCR with 3' and 5' DNA oligonucleotides, respectively (GACTAGCTG-GAATTCAAGGATGCGGTTAAA) (SEQ ID NO: 113) and CAGCCAACGGAATTCATACGACTCACTAAA (SEQ ID NO: 114) (bold, EcoRI site), using SuperScript One-Step™ RT-PCR with Platinum Taq (Invitrogen, Carlsbad, Calif.). Alternatively, reverse transcription is performed, as described below, with 3' DNA oligonucleotide using SuperScriptII™ reverse transcriptase, followed by PCR with Advantage2 Polymerase (Clontech Laboratories, Palo Alto Calif.). The PCR product is recovered from the gel as described above, precipitated with ethanol and cloned into pCR4-TOPO (Invitrogen).

Cloning Protocol 2 (Based on Clontech SMART Technology)

The miRNA sample is polyadenylated in 1 mM ATP, 20 mM Tris-HCl, pH 7.0, 50 mM KCl, 0.7 mM $MnCl_2$, 0.2 mM EDTA, 100 μg/ml BSA, 10% glycerol and 500 U poly(A) Polymerase at 30° C. for 20 min. Excess ATP is removed using a ProbeQuant™ column (Amersham Pharmacia, Uppsala, Sweden) and the polyadenylated RNA is precipitated with ethanol. This sample is then used for reverse transcription using an anchored 3'(SMART) oligonucleotide, (ATTCGAATTCCGAGGCGGCCGACATG$(T)_{12}$VN) (SEQ ID NO: 115), where V=G, C or A and N=G, A or T; (bold, EcoRI site);

a 5'(SMART) oligonucleotide, (AAGCAGTGGTATCAACGCAGAGTGAAT-TCTACGGCCGGG), (SEQ ID NO: 116), and PowerScript™ reverse transcriptase (Clontech). Reverse transcription is followed by PCR using 5' and 3' PCR primers, respectively (AAGCAGTGGTATCAACG-CAGAGT) (SEQ ID NO: 117) and (ATTCGAATTCCGAG-GCGGCCGACATG) (SEQ ID NO: 118) (bold, EcoRI site). The PCR product is purified with phenol/chloroform extraction, precipitated with ethanol, digested with EcoRI and concatamerized using T4 DNA ligase. Concatamers of a size >200 bp are cloned into pBluescriptSK.

Example 5

In Planta Analysis of mRNA from *Arabidopsis*

The polynucleotide sequence of mRNA158 was amplified from *A. thaliana* genomic DNA using primers given in SEQ ID NOS: 385 and 386 (see Table below). The amplified fragment, given in SEQ ID NO: 384 which contained the mature mRNA (SEQ ID NO: 383) (Rhoades et al., *Cell* 110:513–520, 2002) was cloned into the plasmid pART27 under control of a constitutive promoter (SEQ ID NO: 2 from U.S. Pat. No. 6,380,459). The construct was transformed using standard *Agrobacterium*-mediated techniques into *A. thaliana* Columbia and the plants were maintained under non-inductive short day conditions (8 hours light).

Five control sets of plants were transformed with DNA derived from five separate regions of *A. thaliana* Columbia genomic DNA For each of these control sets, a fragment of *A thaliana* Columbia genomic DNA was amplified using the primer pairs given in SEQ ID NOS: 389 and 390; 392 and 393; 395 and 396; 399 and 400; 403 and 404, respectively. The primers were derived from the miRNA sequences listed in the Table below, and the sequences of the amplified miRNA precursors are given in SEQ ID NOS: 388, 391, 394, 398, and 402 respectively. The sequences of the respective mature miRNAs are given in SEQ ID NO: 387, 267, 268, 397, and 401. Each amplified fragment was cloned into pART27 under the control of a constitutive promoter (SEQ ID NO: 2 from U.S. Pat. No. 6,380,459) and transformed into *A. thaliana* Columbia. These control plants were similarly maintained under non-inductive short day conditions (8 hours light).

At 91 dps, 23 test plants were analyzed for development of flowers. Of the plants analyzed, one did not flower, six plants had bolts of less than 2 cm, and eight had bolts of less than 5 cm. Control plants from each of the five control plant groups (20–24 plants per control group) were all flowering at 91 dps with bolts longer than 10 cm (FIG. 151). These results demonstrate that the ectopic expression of the miR158 precursor retarded flowering and therefore acts on a target that promotes flowering.

TABLE

Primers used to amplify miRNA controls

| A. thaliana miRNA | SEQ ID NO: Forward primer | SEQ ID NO: Reverse primer | Length of amplified fragment (bp) | SEQ ID NO: miRNA precursor |
|---|---|---|---|---|
| miR158 | 385 | 386 | 110 | 384 |
| miR171 | 389 | 390 | 175 | 388 |
| miR167a | 392 | 393 | 168 | 391 |
| miR159 | 395 | 396 | 340 | 394 |
| mi39 | 399 | 400 | 1,865 | 398 |
| mi2 | 403 | 404 | 2,934 | 402 |

References: mi39 and mi2: Llave, C., Kasschau, K. D., Rector, M. A. and Carrington, J. C. Endogenous and Silencing-Associated Small RNAs in Plants. *Plant Cell* 14:1605–1619, 2002.

Llave, C. Xie, Z., Kasschau, K. D, Carrington, J. C. Cleavage of Scarecrow-like mRNA Targets Directed by a Class of *Arabidopsis* miRNA. *Science* 297:2053–2056, 2002.

Example 6

Analysis of the Effect of *A. thaliana* FT on Flowering

To test the effect of FT on induction of flowering, the coding sequence of *A. thaliana* FT (AtFT; given in SEQ ID NO: 198) was cloned into the ZYMV vector using standard cloning techniques. Three independent experiments were performed. In each experiment, four to six *Cucurbita moschata* PI441726 plants were inoculated with the ZYMV/AtFT construct and maintained under non-inductive conditions. An empty ZYMV vector was used as control. Results from these experiments showed that experimental plants containing the ZYMV/AtFT construct formed floral buds and flowered within 25–35 days (FIG. 147B). No flowering was observed in the control plants under these conditions (FIG. 147A).

Similar results were obtained when *Cucurbita moschata* PI441726 plants was inoculated at different ages with the ZYMV/AtFT (FIG. 148A) or ZYMV/AtCO (FIG. 148B). No flowering was observed in the control plants under these conditions (FIG. 148C).

These results showed that AtFT and AtCO promoted flowering in *Cucurbita moschata* PI441726 plants maintained under a non-inductive photoperiod.

Example 7

Analysis of the Effect of Two Cucurbit DNA Binding Proteins on Floral Induction

To test the effect of two DNA-binding proteins isolated from cucurbit phloem libraries on induction of flowering, the coding sequences given in SEQ ID NOS: 378 and 380 were cloned into the ZYMV vector using standard cloning techniques. A description of the genes is given in Table 1. The ZYMV vector was used to express these genes in six *Cucurbita moschata* PI441726 plants that were maintained under non-inductive conditions. An empty ZYMV vector was used as control. Up to 50% of experimental plants flowered within 45 days of inoculation with ZYMV expressing either of the DNA binding proteins (SEQ ID NOS: 378 or 380). No flowering was observed in the control plants under these conditions.

Example 8

Expression of *C. maxima* FT Under Control of a Companion Cell-Specific Promoter, Suc2

The polynucleotide encoding the FT ortholog from *Cucurbita maxima* (given in SEQ ID NO: 132) was cloned into the plant transformation vector pART27 under control of Suc2, a companion cell-specific promoter (Imlau et al., *Plant Cell* 11:209–322, 1999). This construct was transformed into 35 *A. thaliana* plants using standard *Agrobacterium* transformation techniques. Sixteen control plants were transformed with an empty vector under control of 35S promoter without a reporter gene. An additional set of twenty control plants were transformed with the companion cell specific promoter PP1 (Clark et al., *Plant J.* 12:49–61, 1997) with a GUS reporter. All plants were maintained under non-inductive short day conditions of 8 hours light. Companion cell mediated expression of FT was analyzed 34 days post sowing (dps) and flowering was observed in 25 of the 35 experimental plants (FIG. 150). Flowering was observed in all 35 plants on 43 dps. No flowering was observed for the control plants on 34 or 43 dps. These results demonstrate the role played by FT in promotion of flowering by acting in the plant vasculature and is consistent with signaling at a distance and a role for FT as a component of florigen.

General Methods:

Plant material is grown in controlled environment chambers as described by Xoconostle-Cazares, *Plant J.* 24:1–16 (2000).

Alternatively plant material is grown in a greenhouse under the following conditions: a minimum of 22° C. (night) and 22–28° C. (day); supplemental lighting (daylength is approximately 10 h/day in mid-winter and approximately 15 h/day in mid summer) to extend daylength to 18 hrs, ambient humidity (normally 50–100% in Auckland, New Zealand), automatic watering and nutrient addition (an equal dose of solution A [calcium nitrate, 85 kg; ammonium nitrate, 7.8 kg; potassium nitrate, 9.6 kg; iron chelate, 0.675 kg; per 1000 l] and solution B [potassium nitrate, 56.2 kg; monopotassium phosphate, 20.4 kg; magnesium sulphate, 30.8 kg; manganese sulphate, 0.17 kg; zinc sulphate, 0.145 kg; borax, 0.240 kg; copper sulphate 0.019 kg; sodium molybdate, 0.012 kg; per 1000 l] were provided to plants such that the conductivity ranged between 23–30 and pH 5.5–6.5 when delivered to the plant pot).

Analysis of Proteins and Peptides

Polyacrylamide gel electrophoresis (1D and 2D) is performed using standard procedures as described in Sambrook et al., Molecular cloning: a laboratory manual. 2nd ed. Cold Spring Harbor Laboratory, Cold Spring Harbor, N.Y., 1989, and Matsudaira et al., A Practical Guide to Protein and Peptide Purification for Microsequencing, Academic Press, 1989).

Mass finger printing and fragment analysis is performed by LC-MS/MS. A general review of mass spectrometry techniques in protein identification can be found in Roepstorff, *Curr. Op. Biotech.* 8:6–13 (1997). Prior to mass spectroscopy, samples of phloem sap proteins and peptides are partially purified by chromatography to remove ions and non-protein contaminants.

Interpro Analysis

The InterPro motif database is available on the Internet.

The software InterProScan Release v3.1 was used to scan the predicted proteins from the cucurbit Stackpack assembled consensus DNA sequences. The InterProScan optional parameters used in running the software were as follows:

Interproscan.pl:
+ipr+go+scr

The Database used was InterPro as of 3 Oct. 2002, distributed together with the InterProScan vs 3.1, and the following component databases were included in the motif searches:

PFAM, PRINTS, PRODOM, PROSITE, SMART and TIGRFAM.

Isolation, Cloning and Sequencing of RNA from Phloem Sap

All cloning and molecular biology techniques, including RNA isolation, construction of cDNA libraries and mass sequencing of cDNA libraries can be performed according to standard procedures (Sambrook et al., Molecular cloning: a laboratory manual. 2nd ed. Cold Spring Harbor Laboratory, Cold Spring Harbor, N.Y., 1989).

PolyA+ RNA is isolated from phloem sap and plant tissues using methods described by Ruiz-Medrano, *Development* 126: 4405–4419 (1999).

Mass sequencing of cDNA libraries is performed using an ABI sequencing machine according to manufacturers instructions (Applied Biosystems Inc, Foster City, Calif.).

Photoperiodic Induction of Flowering

Experiments are performed in either controlled environment chambers or in a greenhouse. Manipulation of the day-length in a greenhouse is carried out essentially as described by Takahashi et al., *Plant Cell Physiol.* 23:1–9 (1982).

Localization of RNA in Sectioned Tissue

Localization of RNA in paraffin-embedded sectioned tissues is performed essentially as described by Eshed et al., *Cell* 99:199–209 (1999) and references therein. Localization of RNA in fresh cut sections is performed essentially as described by Xoconostle-Cazares, et al., *Science* 283:94–98 (1999), Ruiz-Medrano et al., *Development* 126:4405–4419 (1999) and Koltai and Bird, *Plant Physiol.* 123:1203–1212 (2000).

Localization of Protein in Sectioned Tissue

Localization of protein in paraffin- or resin-embedded sectioned tissues is performed essentially as described by Busse and Evert, *Int. J. Plant Sci.* 160:1–13 (1999); Lucas et al., *Science* 270:1980–1983 (1995) and Sutherland et al., *Int. J. Plant Sci.* 160: 1099–1109 (1999).

Plant Transformation

Plant polynucleotide sequences are subcloned into a binary vector (e.g., pART27 (Gleave, *Plant Mol. Biol.* 20:1203–1207 (1992)) and introduced into a plant species (e.g., a cucurbit species) by *Agrobacterium tumefaciens*-mediated leaf-disc transformation (Horsch et al., *Science* 227:1229–1231 (1985). Standard floral dip procedures may be used, as described for *Arabidopsis thaliana* (Clough and Bent, *Plant J.* 16:735–743 (1998)).

Epifluorescence Microscopy and Confocal Laser Scanning Imaging

Analysis of the spatial distribution of the reporter protein, GFP, in plant tissues is performed using epifluorescence microscopy, according to standard procedures (see, e.g. Lough et al., *Mol. Plant Microbe Interact.* 13:962–974 (2000)). The Leica MZFLIII stereomicroscope equipped with a DC200 digital camera for imaging is useful for this purpose. Image analysis, display (adjustments in contrast, brightness, etc.) and preparation for plates can be carried out with Adobe Photoshop software (Adobe Systems, Inc., Mountain View, Calif.).

Alternatively, all permanent images are obtained with the Leica CLSM, using a long-working distance 16× multimedia objective or a 25× oil immersion lens. A low intensity laser (75 mW RYB Krypton/Argon laser [Omnichrome 643-75RYB]) is used to image the spatial distribution of GFP. Two-channel recordings are made using the following filter sets: GFP, 488 nm excitation, 525 nm emission (BPFITC filter). Image analysis, display (adjustments in contrast, brightness, etc.) and preparation for plates can be carried out using Adobe Photoshop software (Adobe Systems, Inc., Mountain View, Calif.).

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, method, method step or steps, for use in practicing the present invention. All such modifications are intended to be within the scope of the claims appended hereto.

All of the publications, patent applications and patents cited in this application are herein incorporated by reference in their entirety to the same extent as if each individual publication, patent application or patent was specifically and individually indicated to be incorporated by reference in its entirety.

SEQUENCE LISTING (872 sequences)

SEQ ID NO: 1 - DNA, 1819 bp, Cucumis sativus
ctctgtgttgctactacttctttcattctctcttcttcttgattcctcatctttagattcttcttacctttttactccttcaattcaccttcttaattgccggaaaccatgagttttctggtgagtttctggtgattttactctcatgcatgatccaagtagctactcttcctttcccaattacatctaaccatgacttccttccaaggttttggcgtcttccagttcgttttgagacggatcgctaccgattgctgtcgctttttttctgtcttgcagtagcgtctaggagccagagaggatttgaagcagcggtagctgctcaggtccgttgatggatcccaactcctcaggagaagacttggttttcaagaccaggaagccatatactattacaaagcaacgagagcgttggacggaggaggagcacaacagatttctagaggcgctgaagctctatgggcgagcatggcagagaatcgaagaacatattggaactaaaactgcagtccagatacgaagtcatgcgcaaaagtttttttcaaagttggaaaaagaagcacttgtcaaggggattcctgtaggacaaactctggatatagatattccaccacctcggcctaagaggaaaccaagtaatccttatccaaggaaaactcctatatcaaagttgggtgctaatgacgggaaggttttgactttggtgtcttcttcacagaggaaacagatcttagatttggagaaagagccactgaatgagggcactagtggagaagaacaagcaacaattgaaaaggatgcccacgacgacaattactcagaagtatttaccctatcacgagaggccaactccatttcttggaaaaacacaaattgtgtaccttcgcaagttaaactaaatgactcatgtgctttcagggagtttgtgccctcacttaaagagccactccaggataaaggcccgggcaaagttttagaaatggagatctcaagcacttcacaagaaaagtctatgcctgctgaaaagaaagaagctttaagctgcgtactgtctggagatgaaatgcaagctgctcataattatccaaggcatgtgcctgtgcatgtggtagatggaagcttgggagcaaatgttcaagggtcagtaaccgatactctgctgcaggaatcgacttttcatccagcaatggaggttcgaggagagcataatataattgggaatccatctgattgtgtttcctttgaacatcaaaataatgcacctaggtgcgtttatcaatcatatccaacaattcatcctactccatttaccttacttcgccctaaccaagagcattataagtcacttctgcacatgtcctcctcattttcaaatcttgttgtgtctacccttcaacaaaaccctgctgctcatgcaatagctagtttgacagcaacatgttggccctatgtgaatcctgaaacttctgtagattctcccgtttgtgataaggaaggttctggaaccaagcaaatgaaccccaccccaagtatggaagccattgctgcagcaactgtagcagctgcaactgcatggtgggcagcccatggactgctacctttgtgtgctccttttcattctgcctttcccagtgccggtgtatcagctcctgtagtacaatcatcagatacctgtcaaaatcttgagtccaaagacaaagcagaaagttcccaacaaattgttgctttgcaaaatcaacagctggatgcagaacaatcagaagctttaactgctcaacactcaggttccaagttacctactcattcatcttctgattct

SEQ ID NO: 2 - DNA, 1271 bp, Cucumis sativus
  misc_feature (1)...(1271): n = A,T,C or G
gatttanattagtcctgggnaatttaccacttggctcgtcttgttttgctgctggaggagctccggcaagtgatatgatcgatgaatttcagcttcaggaccagctttccttcctcaacgacggctctccgacaatcggcgttaagaacgccgacttgtttttcccgccggcggatttatcgtcaagccccaccggtggaggatttgggtcctacggtggagatgccacttggggtggagggccggttcatcgccggagctgctctgtgaacgacgcgtgcttaggaacagaggatttgaattgtgggttgggttggaagccttgtctttacttcgccagagggttttgtaagaatggaacaagttgccggtttctccacggcggacttggggattccgacgtcagcgccgccgccgttggctcgccgagtaagatcgatgtgatggagcagtgtcatgaacttctcagatccaaatcttctgcacaacaacgcctcgccgctgcttctcagcttatggcttcagctaattccttcccttactctccaaaatctatcaacttccttctccaacagcaacaaaacgattcccaaagagctgccgccgccgccgccgccgccgccgcagcgttaatgatgggggaagatctacacaaattcagtcggtccagtcgacttgaacgaaacgaattctcgttgaacggcagcgccggtatcatcaatccggcgtcaagacagatctacttgactttcccagctgatagcaccttcaaagaagaagatgtatcgaattatttcagcatgtacggtccagttcaagatgtgagaatcccatatcaacagaagagaatgtttggatttgttacttttgtttatcctgaaacagtgaagctcattttggctaaagggaatcctcattttgtttgtgatgctcgtgttcttgttaaaccttacaaggagaaaggcaaagtcccagacaagaaacagcaacaaatcgatagagatttctccccttgtggaactccaactggtttagattcaagagaactttatgatcatcttcaacttgggtcgagaatgttttataattctcaccaagatctgttatggcgaaggaaattggaagaacaacaagctgatcttcaaacgcttgatcttcaaagtcgacgccttttgaatctgcagcttcttgatgtgaagaagaatcagcttccccatcaccaccaccgtgctctttccaccggtagcccaattccttccccgacgcattca

SEQ ID NO: 3 - DNA, 1303 bp, Cucurbita maxima
cggataactgggaggcgcccacatttgaacaccaggggagggacaagccatatgaccccacgatccgatgggggcgactggcattacatgatttgaatggtagggagaagggtaggccatcacaggtctctgtagatgtggatagtagttcttcctcattggatcctttgaactcgaccagctaccatcttcttctttcggcaagacgtgtcgcttatgcatccgatacttctgaagatggctagctacattatgccttgtcaggccttcaactttcatcaactctagaattcgagaaggaattgcttgattcactccgagttgttccactgcctgtacgaacttccgatgaagttcggctgtccagtctactttcatcctacacgggttaccaagaccgcatgctttgctcttgtttttttcggaactgctaatgttgtctctatcgtgtaactcgtgatcgacattactcgcagccccacagccatcagtagagttctcttcctctttaataacttccttgtcagataactgagagttctccacttgagcagtacaagtagtttcgacagatttagactcctccctgtcttgctcgccgcactctttctcgagcaaacagttcatttgatccaccaatctcattccatgcttttgctgaggagttgaaggagctggatacttgtcacttccttctggtagtagtagtagttcatgatcatcaacattgtcgccgctcgatatttccaactcatgtggaacttgattcttgttctcatcgttttccaattcaagatgcaatatggaggcaacagattctttgataggctttaaagaactcgggacggcgctcccgcctgcattgaatgccttatgaacaacatgctgccaaatgttcctcagtttgtccttagacaccggtttctgaaggaactcgatcgcaccaagcgctatgcacttcatcatcgtgctgaggcaatggatgttcgaaattaaaatagtaggcaagtccttaacagcttcaagaaatttaaacgccccatcgtgatcactcgccattacctcgacaatggcgacatgaaacgtttcaggttcgctcgaaatggctaacaatgcatcgttctcattgcagtaagtcacaacaacatactccatttcctccagctttgtttttatctcagcagcagaattgctgtctccatcaaggaggagaactctaagcccctttggaaaatctttccacccatgtaaatcactagcagtgcaaaccatagctcgttgtgcatcgttctcacgtatccta

SEQ ID NO: 4 - DNA, 651 bp, Cucurbita maxima
ggaagacaacaacatagatttctggagaaaatttgttaacgagtactttgcacctcatgccaaaaagaagtggtgcgtttccatgtatggaagtgggcgacaaacaactggagtttttcctcaggatgcatggcattgtgaaatatgcaaacgcaagcctgggcgtggctttgtagaagcaactgctgaagttcttcccaggctttttaagatcaagtatgaaagtggaactatggaggagctactttatcttgacatgccccgtgaatatcataatgcttcgggtgagatcgtcctggattatgcaaaagcaatacaggaaagtgtttttgagcaacttcgcgttgttcgggatggccaacttcgaattgttttttctccagaccttaagatatgttcatgggaattctgtgctcgacgccatgaagaacttattccgaggagattattgatacctcaggttagtcatcttggggcagcagctcaaaagtaccagtctgccattcaaagcgcatcatccaatttatcaactcctgaattgcaaaataattgtaacatgtttgtggcatcagcacgacaattagctaaagccttggaagttccactggtaaatgacttgggatatacaaagagatatgtacgttgtcttcc

SEQ ID NO: 5 - DNA, 852 bp, Cucumis sativus
ttctagcggtggtgggtactctccttattatctacaggaagcattagcgatgttgaagcggtatcttccgtctaatgaggcggagatggactcggatattgatgtttcgggtaaggagatagattctccgttggatgcctactcctctgatcagtttcgaatgtatgagtttaaaattaaaaagtgtacgagaggaagatcgcatgactggaccgagtgtccgtttgctcatcctggcgagaaggctcgccggcgagatccgaggaggtattattattcaggtacggcgtgtgcggattttcggaagggaagctgtgtgaaaggggatgcgtgtgagtttgctcatggagtttttgagtgctggcttcatccggctcgttatcggactcagccgtgcaaggatgggacgagttgccggaggagagtttgtttctttgctcatacaccggagcaacttagggttttgcctcaacaaagtcctcggagtacgagctctatcccttcgtacgatggatcgcctctccgacaagcaatcgaggcctgtgcaaaacaaatgccctatttatcatctccaggaacatcgccaccagtatctcctcgaattgaatctccacctcaatcaccgattattaaatcactaaatcgacctcacgcaccaagttcgatcaaagaaatggttgcatcactgcgaaatttacaactcaataaggaactctgtaagttaccatctccttcttcttcttcttcctcatggaatgttcaagtcggatctcctgtattcggatctccaaaggaatccaccactcgatccggtttatctacccttccagaaacttcaactcctccacgtat

SEQ ID NO: 6 - DNA, 577 bp, Cucumis sativus
ggcattcaccggaagccaacggaggtgagctcacagaaagaaagggctgatggagtcaaattcagagccaagactgaagtaaaagaaagcagtagaagaacgcagagatcctcgtcgatgtataaaggcgttcgacgaaggaaatgggggaaatatgcagcagagattcgcgacccctttcgcggtagaagattatggctcggtacttataacaccgcagaagaagctgctgttgcttatcagagaaagaagcatgagtttgaaagtatgcaatccatggagaattacagcagtgaactaagtggagggaaatttgaagagaagaagatcaaatcacttgttgatgacactgccgaatctgaagaaattatagctatgttttctcatccttcaccatcttctgtacttgatctctgtactggaagtttaagcagcaatggactcaagaatgtaattgaagaattcaaagtggatcaaactagggaacatacaatcaccaaaaagagtaagcctgtgcaagatggactttcaagtacttgaagacaatgcaatgatctgcaatgatttcgatcagtta

SEQ ID NO: 7 - DNA, 981 bp, Cucurbita maxima
gcttcgttctccccgaaagtaaatcgcactctcgtctctcttcttctgctttcatctctcagtttttgactctttattaaaacaaagaaacagagagaatctctccggccgattacttcttcttcttcctcccttccctgtttcttctttatcatcttctttccctgcgctttcaccgacgatggcggttttaaccctcagttccctccccctgggcttccgatttagacccaccgatgaagaactcatcaacttctacctccgctccaagatcaatggaaatcacgaagaagtcagcgttattcgcgaaatcgatgtctgtaaatgggagccctgggatcttcctgatctatcgataataaagacaaaagatcccgagtggttcttcttttgtccacaggacaggaagtatcccaacgggcaccgtttgaagagagctaccgatgctggctactggaaggcaacgggtaaggatcgcaaaatcaagtccggaacaaacttgattggaatgaagaagacattggtattctacaaaggtcgtgctcctaagggaaagagaaccaattgggtagtacatgagtatcgtgccactcttaaggaacttgatggcactaaccctggacagagtgcctttgctctctgtcgtctgtttaagaaacaggatgaaagtattgaagggtcaaatggcgatgaagctgaagctgctatttcatcccctaccacagctgactcatctcctggacctggagactcccattcagagccaatacttcctttagtttctccatcattgccggggcgggctgaaagttctgatgaagtggcatccgaaacagtcgaacatcctgatggttcagctgaaatctcttgttttgattcatataatgcagaagtgagaggctcccttttccttttcatttttattacaagaaattcagcataatctgaattgtatgcatctatgtctatttctcattgcac

SEQ ID NO: 8 - DNA, 679 bp, Cucumis sativus
  misc_feature (1)...(679): n = A,T,C or G
aagacaacaatggtagtttggctcttgggatgttcatgggaaatcagataactgagaacaaaaatatggtttctaatcagaatcaaaatccagtgtttttagggacaggagttgtaaggtcttctcagccgcagcagcaacagcagccactttttcccaaaccagctaatgtgacctttgcttcttcaatgaatttagtgaacaatccccagcttaccaatggatctgggactaatttggttgtggccccaaaacctcctttgcatgatgcattaattcaaggcacgggcattggtgcgatcggcttaggcacgagaggtgtaactgttgcttcaagatctcctacaagtacaatatcatctgatgtgattacaaaatccagcattgaggcgtcttcattttcacccgttccattttcatttggccggggtcggcgaagcagtggagctctggagaaagtggtcgagaggagacaacgaagaatgataaagaacagagagtcagctgcaagatcacgggctcgtaaacaggcttacaccttggaacttgaagcagaagttgcaaaactcaaagaaatgaaccaagagttgcagaagaaacagagagagataatggagacacagaaaaatcaggttttggagaagatgaaatatcagttgggcggcanaagattctgctt

SEQ ID NO: 9 - DNA, 2176 bp, Cucurbita maxima
gctcaaactccccctccaagcgaggccttctcgattcaactattcaacttgtttcttcaatctacttccaggagctggatatgtgcagtggctcaaagaataaagttgctttctcgaattccgccatggaaactaagtttcagaagcttagagatggagctttattctctgcgaattcgatcttgcttgaactatcagcctctgatgatgtagatgggttcaagagagaggtggaagaaaaggatttggatgttgatgaaccaagctgctggtatggaagaggaattgggtcaaagaagatgggttttgaagaaagaactccacttatgatcgctgctatgtatggaagctctaaggttgtcaaatacttaattgagacaggcaaggttgatatcaacagggcttgtggatcagatatgaccactgcccttcactgtgcctctgctggtggctctggttcttcccttgaaaccatcaagctcttgcttgacggatcggctgacgtcgattgcgtcgatgcgaacgggagaaaacctgttgatttgattgtttcagcttgcaggatggtgtgttattcaggaaggaaagctatggagatgttgttgagaggagatggtatggctggggtaggtgatctgagccttttcctagaagaagaccatcagaagatctcagcttccctgtctgcaaaagaaggaagtgacaagaaagagtatcccgttgatatatcgctgcccgacatcaacagcgggatatatggcactgatgatttcaggatgtatactttcaaagtgaagccttgttcgagggcgtattcgcacgattggaccgagtgtcctttcgttcatcctggcgagaatgctaggcgtagagaccccaagaagtacccttatagttgcgtcccgtgccctgaattccgaaagggggcttgtcctaagggagattcctgtgagtatgcacatggtgtctttgagtcttggctccaccctgctcaataccgaacccggctctgcaaggatgagactggctgcacaaggaaggtctgcttctttgctcacagacctgatgagttgcgccctgtatatgcatcgacaggctcaggcatgccttcgcctaggtctctttcgagcagtgctgcagatatgtctaccatgagcccgttggctcttggttcatcgtcgttgtcgttgccgactgcttcaacgcctcccatgtctcccttagcatcggtgtcttcccctaaaaatgggaacttgtggcagaacaagattaaccttactcctccggctctgcagctccctagtagtcggttgaaggcgaccttgagtgcaagagatttggatttagagatggaattgcttggattagaaaagaacgtgagccaaatgcaacatcaacaacagttgatcgacgagatatctcggctctccgctccttcttactggagtgcagacataagcaggagtgcagagttgaagccatcaaaccttgatgacatgtttggatcattagattcttccttgttgtctcagttgcagggcacgtcgctaaaaacgccaatctcggctcaagttcaatctcagaccgggctgcagatgcgccaaaacatgaaccaactccgtgcgagttacccggctaacttatcatcctcacctgtaaagaaaccctcttcatttggctttgattcatcaagtgcagtggcagctgctgtgatgaactcaaggtctgctgcctttgcaaaacgaagccagagtttcattgatcgagctgcagtgacccgccttcctgggcttactggagctgcaaattctgcagctacaatgtcttcccatctctcagattggaactcgcccaatggcaaactagactggggaatgcacagcaacgatctcaacaaactcaagaaatctgcctcgttcgggatccgaaacaatggcatgggaactcccacgttcgcttcaccagtagaggagcctgatgtctcttgggtaaactccttggtgaaagatgttccctcggacaggttcggaatgttcggtgcggagaaacgagcatacaacctcaaaagagacatcaacgagatgctaccgtcctggatggagcagcagttgtatgcagagcaggagcagacagtggcataaacaacagctgctacgattcctactcttcaatatgc

SEQ ID NO: 10 - DNA, 855 bp, Cucurbita maxima
gtagaaacatcctgctcagatccttcaaccactctccgtcgcaagaacaccaaattaattccttcaaccgccatggtttccaaagagaaatccaccgccaaaaagcttcctcctctctgcaacaccaacaacaatgccagagaactccatttccgaggcgttcgtaagaggccttggggccgatacgccgccgagatccgagatcctggcaagaagagccgcgtttggctcggaaccttcgatacggcagaggaggcggcgtatgcttacgataacgccgcgcgccagttccgcggcgcaaaagctaaaaccaatttccctctacctgatgagttgatcgacgtttctcctcgcaagatcagccaaagccctagccctagcagcaccgtcgaatcctcttcctcctccagccaagaaaaaactccctcaccggagatcgtccgtagctacggcgtcgcacgaacttttccgttcattcagccgcagtttttgcatcaagtcggcggaggcggtagcgctcgtcctgttttgttcatggatgcttttgttcgacctgagtttgttgctcagggctatcctattcggtacgattcggcaaggttcgccggcgagatccagaccaaatcggattcattgtccgtggttgactgccggccggcgaaggaaattctcaatctcgatcttaatctcgctccgcccgtggatgcttgatttctccgctaattttgtcctttttgttttggattttttttttaaaaaaaattaatttagttagatctttagaaatagaacaaaaaaaattaacgtactgtaaagaaaaatgaaaaataaaaaatagggttttttttttttttt

SEQ ID NO: 11 - DNA, 1270 bp, Cucurbita moschata
agaagcgatgtacttcgagcttcagctgtcggccgacttcgaggttattaccgtcccatcgcattccattgcagacattgtaagtttgctaaccgaactcatcatcttcacatcctgactcgaccatatatatattcttctcaccatgttacagaattcctgccacgggtaatcgcccatgagcatcgtatctccttcgtcgtctgtgaagacaatctcccacttatcacgtgggtgaagttctcccttgatatcgaacatcttttccagttcgtcgatgagttggccatacccttccaacatcgtaaggtccaccgcacgtccgacagccatcccctgcatttgaaccttggtccgacttcggctgttggtcgagctgctctgcttgtgctggatctctttaggaggtacttgtaaaagtcctaattttctttctttagaagcctttggctggtctgagttctgctctgcatcagtgatttcatttggtgcgctaatcggttgatcagcagccatttcaggtggaactgggctcttggaatgaccgatgatatcgatcccgaacaagcgacagcttggagccacctcagttttcctccccttttccccaagatcgttaacttggtcgctgctctttggattagatgggtgtggagctggacatgtcgactgtgctgctggcgctcccgagaagacggttgaccaaacataattgctgtttcggtcatctgtcaaattctgtaatcgatgctgcgaaacactcctgtttggggaagctaaccaagagccctccttcggagtccttgatatagaattcccaatgctgctaacatccgtttgcttgtaattccacattgcgtgattttcaaatcgtttcatttcagcagcagtaccgctaagctgtgttctatcgtcgtgtgattgagttgatcctggatggcgtagagttgttacggttgaattatcagaatctggaatgtcgagtggaggccgaagccttttattctttaccgaaaccgattgtggaatgctcggggacgtaggcgccacaaaaggttcaatctcccatggcgaaactctatcaggtcgaggaatagatgcaagttcatcccattgaattcttagcgatcgccattttgaattgggccagtgaggagatatgtcgtcaactccaacaatggtacccgaaaaccttctctcaggagactcctctccctcgaatctcatcttgaatctcatcccaactaagaacttcctgttcatcgcttct

SEQ ID NO: 12 - DNA, 989 bp, Cucurbita maxima
  misc_feature (1)...(989): n = A,T,C or G
cggggnaaattagatcacaacacaccnagcgttctcagggtaatttttcattgaggttagccggaaaatggtcaacatgcttgaaactgatctctgtctcgggcttcccggcggcggaggtggagagccggagactccgaaaggtaatggaaaaagaggattctctgagacggttgatctgaaactcaatatccaatctaagcctgtggttaccgtcgatctgagtaccacacagaacatgaagagtactgattcagaggatattagctccaaggatcctgcaaagccacctgccaaggcacaagtcgtggggtggccaccagtccgttcctaccgaaagaacgccatgtctcaaaagaatcccgatggtggagaaaagggtagtggctcagctatgttcgtcaaagtttgtatggatggcgcaccatatctacgaaaggtggacctaaagacgtacaaaagctaccaagagctctcgaacgccttggctaagatgttcagctccttcaccatggctggtgagtatggggcccaaggaatgatagatttcatgaacgaaagcaagttgatggatcttctaaacagctctgaatacgtgccaacctatgaagataaggatggtgattggatgctggtgggagatgtcccatgggagatgttcgttgattcatgcaggcgcttaaggataatgaagggatcggaagctatcgggctcgccccaagagcgatggaaaaatgcaaaagcagaagctgaaagaggagtctgattgcaatatttgtgtttttttttttttttaatttaaatttaaattttgaatgttgtgattggtaaatagatattaaaagagatttgggagattaattaattaatttgtaataggaaacaagaaaataaactctctctctctctatacctctctctatctctctcctatcctgtctggctgtttgtttgtttgtctgtttaatcacaaaaaacaattataatg

SEQ ID NO: 13 - DNA, 1382 bp, Cucurbita maxima
tagaagcgatgtgcatatgccggacatggatggattcaaacttctagagcaagttggtctggagatggatttgcctgttatcatgatgtcagcagatgatggaaagaatgttgtgatgaagggagtgattcatggtgcttgcgactacctgatcaaaccggttcgaatcgaagcgctcaggaacatatggcaacatgtagttcggaagagaaagagtgaatggaaggatttagagcaatctggaagcatggacgatggagatcgggatcaaaatctatctgaaggtgcaaattattcatcttcggcgtatgatggaagttggaacagctcgaagaggaagagggatgctgaagaagagctcgaggagagggacgatacatcaacgttaaagaagccgagggtggtatggtcagttgagctccatcaacaatttgtcatagcagttgatcagctaggcattgacaaggctgtccctaaaaagatattggagttgatgaacgttccggggctttctcgagaaaacgttgccagtcaccttcagaaatatcgcttatatcttagaaggcttagtggggtatcgccacacccaagtaatctgaacaatgcttttatgaaccctcaagatcatcctccttttgggtcaatggcttcatacaatgggattgatcttcagacgcttttggtcaccggtcaactctcgccgcaaagtctcgctgcccttcaagccaccggacttcgtcggcctaccgcgaaatctagcttaccgatggcccttgttgatcagaccaacatattcagctttgaaaatccaaaactgaggtttggtgaggaccaaacacaacacctgaataaaactaaacctgcaagcttgtttcatgggattccaacaaaaatggagccaaagcagcttgccaatatgcagcacccttctgtgcagactcagaggaacatgaacatgccactcaatatcaagagcgaacatggtggcactcagctaatgcatttgtctcagcagcaaactgtagggcagactctaaataactctactgttagccacctacctggaattccatcgacattaaggaacccgatcatatcaggtagcgttacaacggggaacgggactgctgataatagccacggacctcgatacaacctagtttcgcccacatcggttatggtgaactatccaatgagccaaaccacagaagtgtttcaagaagaaatgaattcaaatctaaaagtatcgagcggagtaatgtcgagttatgatgtttttagtgacttgcatatgcagaaagcccatgactgggattatcaaaatgtaagcactttggcctttggtactccacaccatggaaacttcattcaccatcgcttct

SEQ ID NO: 14 - DNA, 1274 bp, Cucurbita maxima
agaagcgatggatgaaatgaaagtgaaaccggaggaatcagtggccgtcggcacggcggtgtgttcttcttcttcttcgtcgggttcgagcgtcactccccagccgatcgaagggatacacgatgtaggtccgcctccatttctcactaagacctttgaaatggtggaagatccattgacggactccattgtttcgtggagtaaagctcgtaatagtttcatcgtttgggattatcacaaattctccagttccttgcttcctcgatacttcaaacactccaatttctctagtttcgttcgtcagctcaatacttatggttttcgaaaagtcgatcctgatcgttgggagttcgcgaatgaggggtttctgggaggacagcgacatctgctgagaacgataaagaggaggagacattcacctcaaagcttccagcaccaccaaggaggaatatgtgtagaattgggtgaatttggactggaaggtgaactcgagaggttgaaaagggacagaagctcgttaatggcggaattggtaagattgcgtcagcaacaccagagctcgagagagcaaataatagccatggaggataggctagagaagtctgagaataaacagaagcagatcatgacattcctcagcaaagcccttaagaatccatcattcgttcagaaatttatccatagtaatcagggaagagaattgagaggcgttgaaattggacgaaagcgaagactgacttccggctcaagtgtagagaatctccaggaagagagtgtaccagcggctgttaaacaagaagagccagatatggagacgctgttagcagtcaactttgaaggcgagtcaaacggcgagatcacagaccctgtttctgatggcattctcatggcagccatggatgtgggtcactcagctcccgaggaactggggttcttcagtcaactctgggctgaagatccttgggctggatatccagaggaagaacccataatagttagcaatcaatcggacatcgatgtggaagtggaggatctgatcgccgagccccctgattggcctgagaatttgcaggaactcgtcgatcaaatggagtttctccggccgaagccataggcataagaatatagggagtgaaatcaatgtgttcagctggctctggtgtagaaaaggagtgggtggaggaggatgcagaggagccacagattatcatatcctttgaaactcattgggctttcaatattatctacttcaatatttttggttgttgtcttcc

SEQ ID NO: 15 - DNA, 606 bp, Cucurbita maxima
cggataactggagaaaatatggacaaaaacaggttaaaggaagcgagtatcctcggagttattacaagtgcacacatccgaactgtcaggtcaagaagaaggtcgagcgatctcatgaaggccatataacagagatcatctataaaggaacgcatacccatgtaaaaccctcaccgaatcgacgagcatcggattcccatatcaatatgcaactagacatccctgtacaagcaggccaacagaatgctgaagttcccctgtgggaagattcacaaaaagggactcctgattggatgcatagcaaccttgaggtgagttcttcagcatcattgggtcctgaatatggcaatcatattgaaacagctgaggccattgatgcctcatccacattctctaatgatgaagatgaagatgatagaggaacacatggaagtataacaatgggatatgagggggaaggagatgaatctgagtctaagaaaaggaaactcgacgcctatgtaacggaaatgagtggggctactagagctatccgtgagcctagagttgttgttcagactaccagtgaagtagatattctcgatgatggctatcgttggcgtaaat

SEQ ID NO: 16 - DNA, 612 bp, Cucurbita maxima
taagttggctgagctttggagcagtgatcccaagcgcgccaaaaggatattggcaaatcgacagtctgctgctcgctcaaaagagaggaaggcacgatatatacaagagttggagcgcaaagtgcaaacccttcaaacggaagcaactactctatcagcccaattgactctcttccagcgagacacaacgggtctcagtactgagaatacagagcttaagcttcgtttgcaggctatggagcaacaagcccaaatgcgtgatgctttgaacgaagcattgaagaaggaagttgagaggcttaaaattgctactggagaaatgatgagcccttccgagtcttttaacttgggaatgcatcacatggcatacgccccatcgtctttcattcaactttcacagcaaccagggtctgctggccctcaaaacattcaaatgccaccatataaccattccccatccaacatgtctagccaccctctgcatccatcagactctcattctctctcggaggtgctacaaagcgaccctcttggtcgattacagggtctcgatatcagtagtaaaggatcgtcgcttgtgaaatccgaggacccttctctctccgctagtgt

SEQ ID NO: 17 - DNA, 671 bp, Cucurbita maxima
agtgaatgcgactaattcctctgccgtcattgatagttatcacaatacttcttccggcgcgcccaagactgtggatgatgtgtggagggagattgtatcgggtgagaggaaggagttgaaggaggaggttactgatgagttgataaccctcgaggattttcttgtgaaaactggagctgcgcctgtcgaggatgtcaaattgccgcagacggagaggctgagtggagggattttttcgtttgattcaattccaggcagctcgtttcaggcagtggaaaaggttgaaggatccattgtgggatttgggagtggggttgatttggttggcagtggaggaagtgtggggagagggaaaagagggcgagctgccttggagcccttggataaggctgctgagcaaagacagaggaggatgatcaagaatagggagtctgctgcaaggtctagggaaaggaagcaggcttatcaagtggagttagagtcgttagttgcaaaattagaggaggagaacgagcggcttttgagagaaaaggccgagaggagtaaggaaaggcataagcagctaatggaaagggtgattcctgtggttgaaaagcgacgacccccacgagggattcggcgagtgaattccatgaaatggtgaactacttatcttccacgagacgcattca

SEQ ID NO: 18 - DNA, 672 bp, Cucurbita maxima
aagtatggtacggtgttccaggaaacggtgccggtaaattagaagaggctatgagaaagcatttacctgatctcttcgacgaacaacccgatttgcttcataaattggttacgcaactttctccgtccatactgaaatctgagggtgtacctgtatataggtgtattcagaatcctggagagtttgttttgaccttccctcgcgcataccattcgggattcaacagtggtttcaattgtgccgaggcagttaatgtcgctccggttgactggttgccccacggtcaaattgccgtagaattatatcgtgagcagggacgaagaactactatttcccacgataaactactgctcggtgcagcgagggaagctgtgagagcacactgggaacttaatttacagaaaaggaacactttggataacttaagatggaataatgtttgtggaaaagatggagtcctagcaagagcattcaagacacgtgttgagctggagtgtgcacggaggaacattccgtgcggttcttctcgggcaatgaagatggaaagcaactttgatgcctctaatgagagggaatgcagttcatgcctctttgacttgcatttgtctgcagttgggtgccgttgttcaccagataagtatgtgtgcttgaatcatgcaaaccagttgtctt

SEQ ID NO: 19 - DNA, 736 bp, Cucurbita moschata
tttttcgtaggcaagatgtccccctgctgcagcaatatctcaacaatcatttcagagaatttaggcatatccacgctggtccagttccacaggtgtttcatccagtgcatgatcagtcattttatttgactttggaacacaagagaaagctcaaggaggaatatggaattgaaccttggacgtttgtccaaaatctgggagatgctgtctttattcctgctggttgtcctcatcaagtcagaaacttgaagtcatgcataaaggttgctatggactttgtctcacctgagaacgtgggagagtgcatccacttgactgaagaatttcgcagactcccgtcaaatcattgggctaaggaggacaagttggaggtaaagaaaatgagcgttcatgctatgaaagcgacaattgcttgtttgaaggaaaagtgcaagtgatttgcctaatttaggatatttcttatgagcctcgggggcaatcctatgaccagaagaacgtgcacaaggtttgagttggtatgtaggatgactaatcctgaacttttgtgataccaactgttttgtagcagtagaactatgccccatacattttgtacaatgattcattggctctgttactcccttgtatgatataatagtttatccataacttacgccgctatgtcatttatcagctacgagattcggggtatcgctttcgacccctttttggcatttttgtatagataacatcgctt

SEQ ID NO: 20 - DNA, 745 bp, Cucurbita moschata
aagacaacctttctgtctgataaaacaaaacttttgaaaaacaagaagttaaatcctagtccgtggcctccttcttccaaatcattgcataaagggagagttcaaaatagtgttcagcatttttcttgtccatcaaaagaatgtggcagctgcagtgaaagtcttctcgaattgagatgtattttcccactaagttggacaaaggaactcgaagtgaacgcagaagaaatcgtatgcagctatgactttccagagtctgttgattcatcatcaaactgtactttgtgttttggtgaggaccataaagttgatgaacttgaagagttccagaaagtagctgtccgggaggattcaaatgataactatttgtattatcccaacctttttcgcatccgtcttgatgaccttgaccattttcagaggcactggattagaggtcatcctgtaattgtgcgtaatgtactggagacgtctgatctgacatgggatccagtagttatgtttcgcacttaccttgaaagaatcatttcgagatatgaaaatggtacgagtctcccagaagcttccaataacttggactggtgcgaggtagaaattggcattaggcagtactttatgggttctcttaaggggaagacacacacaaacacttgtaacaacatgttaaaattaaaaggttggctttcttcccatttgtttcaagagaagtttccagctcactatgcagaaataatgcgaattctac

SEQ ID NO: 21 - DNA, 669 bp, Cucumis sativus
gccgatttgcagttaccgccgggatttaggtttcatccaactgacgacgagcttgtgacgcattatttgtgtcgtaaatgtgcgtcgcagccgatttcggtgccgattattgctgaaatcgatctttacaaatataatccatgggatttgcctgaaagggctttgtatggagagaaagagtggtatttcttttcaccgagagaccggaagtatccgaacggttcgaggccgaaccggtcggctgggagtggatattggaaggcgaccggagctgataaaccgataggaaggccgaaggcggttgggattaagaaggctttggttttttattctgggaaagctcctaagggtgagaaaaccaattggatcatgcacgagtaccggctcgctgatgtggaccgctcggctcgaaagaagaatagtctaaggctagacgattgggtactttgtcgcatatacaacaaaaagggggcaatcgagaaacagaacccgccggagatgaacacgattgggttctttgaaaatgaggaacaagaggaaaagcccgaaattctgaatgacagagcaatttctgggcgaatcccgtcggcatcacctttgcaaggtccgccatcgtccggcgtagttaacgattacgtatactttgacccctcagattcaattcctcgt

SEQ ID NO: 22 - DNA, 661 bp, Cucumis sativus
  misc_feature (1)...(661): n = A,T,C or G
atcacacccacaaagaaaaaacacttctaacttaacttacactactttatatatatatattatacacacacgtacatatacagttatggatttttctgatgcttcttcgtcttcccatcgttccactctttccgacgacgagcttcttctggcgtctcgataccccaagaagcgagcggggagaaagaagtttaaggaaactcgtcatcctatttatcgtggtgtgcgactgaggaattctggtaagtgggtttgtgaagttagagagcctaataagaagacacggatttggcttggaactttccccactgctgagatggctgctcgagctcatgatgtggctgccatcgctcttaggggaaggtcggcttgtcttaattttgctgactctgcttccacgcttcacattccggctagtgttgatcctaaggatattcagagggctgcggcggaggctgccgaggcattccggccgcaggatgatgagttgacgccggcggtggtggatgangaggggttttatttggagaggaagtggagtttgggatgcccgggttgttgacggatatggcggaggcaatgttgttgccgccgcccaattgtgtggggaattacgacaatgaccactttggggctaattctatggattttgatgccgaca

SEQ ID NO: 23 - DNA, 556 bp, Cucurbita maxima
  misc_feature (1)...(556): n = A,T,C or G
ttggccaattgtttgattcttttggcgcaggggagaacaggggattgcgcctctgttttggttcaacacaatcaatctctgttcgcttatcagtgcaagacttgcgatcgttgttttccttcttttcaagccttgggtggacatagagctagccataagaaacccaaaatctctaattctcttcaaacccacgaccctcaatttcacctctccttgcagttatccaccggccgaccaccggcgagtttcgccgccggtgacgtcgttaagtctaaggttcatgagtgttccatttgtggagcggagttttcttctgggcaggcacttggtggtcatatgagaagacatagagcgttgacctctacggcgtcggtggcgagtagaggtgctactgctacgccgcagttgcaggagttgatgattaagaaagagaggaatgtgttggagttggaccttaaccttccggcgccagaggatgaccggcaccggacggcggtggctgtgttctccgccgcatcgtcactggtggattgtcattactgattgattntttttt

SEQ ID NO: 24 - DNA, 734 bp, Cucurbita maxima
  misc_feature (1)...(734): n = A,T,C or G
gggggtgggaaaagattcggttcttgaataaccagtgttgttggtaagggaaccgggngaaagaaatggcgccagtggggttgcctccagggttcaggttccatcccaccgatgaagagcttgtcaattactatctcaagaggaagatcagtggccaagtaatcgagcttgatatcattccagaggtcgatctctacaaatgcgagccttgggaattatcagaaaagtcgtttctgcccagtcgagacccggaatggtacttctttgggccgagagataggaagtatccaaatgggtttagaacaaacagagccacgagagcggggtattggaagtcaactggaaaagacaggcgagtgacttctcatcaacgtgccattgggatgaaaaaaacacttgtttactatagaggccgagcccctcaaggcattaggaccgactgggtcatgcatgaatatcgcctggacgacaaggattgtgaagacagctctggtattcaggattcttacgcgttgtgtagagtgttcaagaagaatggaatatgttcggaggtggaagaacaattgagcgggcaaagcagcagcagcagtttgtcatttatagacaactcaaattcaacatcacaaactttggtcaatgattacgaaactttatctcctgatgttctcatgccatcaccttcgtcatcttgtgtcgaggaagaagaaaggacgattcatggatgcagttcatta

SEQ ID NO: 25 - DNA, 621 bp, Cucurbita maxima
gggcaaatccccaaacccaaattaacacacggattacacaaattcccggtttaatggagaattatcagatgttcttcccttgctccaacggcggcggactgtcggcttatagtcaactcgacatctcatccggcaccgcctctgacatgttccggaattttcacggcggcgatccgcaagcaagtggcgttttggggcttaagacagaggtggttacggcggcggtggaagccgacaggaactgtggcggcagcgcaaataagaaaggggagaagaaggtgaggaaacccagatatgcttttcagacgaggagtcaagttgacattcttgacgatggatatcgttggagaaagtatggtcaaaaagcagtcaaaaacaacaagtttcctaggagctattatcggtgcacgcatcaagggtgcaatgtgaagaagcaagtgcaaagactaaccaaagatgaaggggtggtggtaacgacgtatgaaggcatgcatacacactccattgataaaccaacagacaactttgaacaaatcttgagtagaatgcagatttatagtactcctttttgagctcaaactcagcatccgttccgtttcataaccaagaacgagaacgaga

SEQ ID NO: 26 - protein, 495 aa, Cucumis sativus
MDPNSSGEDLVFKTRKPYTITKQRERWTEEEHNRFLEALKLYGRAWQRIEEHIGTKTAVQIRSHAQKFFSKLEKEALVKGIPVGQTLDIDIPPPRPKRKPSNPYPRKTPISKLGANDGKVLTLVSSSQRKQILDLEKEPLNEGTSGEEQATIEKDAHDDNYSEVFTLSREANSISWKNTNCVPSQVKLNDSCAFREFVPSLKEPLQDKGPGKVLEMEISSTSQEKSMPAEKKEALSCVLSGDEMQAAHNYPRHVPVHVVDGSLGANVQGSVTDTLLQESTFHPAMEVRGEHNIIGNPSDCVSFEHQNNAPRCVYQSYPTIHPTPFTLLRPNQEHYKSLLHMSSSFSNLVVSTLQQNPAAHAIASLTATCWPYVNPETSVDSPVCDKEGSGTKQMNPTPSMEAIAAATVAAATAWWAAHGLLPLCAPFHSAFPSAGVSAPVVQSSDTCQNLESKDKAESSQQIVALQNQQLDAEQSEALTAQHSGSKLPTHSSSDS

SEQ ID NO: 27 - protein, 399 aa, Cucumis sativus
MIDEFQLQDQLSFLNDGSPTIGVKNADLFFPPADLSSSPTGGGFGSYGGDATWGGGPVHRRSCSVNDACLGTEDLNCGLGWKPCLYFARGFCKNGTSCRFLHGGLGDSDVSAAAVGSPSKIDVMEQCHELLRSKSSAQQRLAAASQLMASANSFPYSPKSINFLLQQQQNDSQRAAAAAAAAAAALMMGEDLHKFSRSSRLERNEFSLNGSAGIINPASRQIYLTFPADSTFKEEDVSNYFSMYGPVQDVRIPYQQKRMFGFVTFVYPETVKLILAKGNPHFVCDARVLVKPYKEKGKVPDKKQQQIDRDFSPCGTPTGLDSRELYDHLQLGSRMFYNSHQDLLWRRKLEEQQADLQTLDLQSRRLLNLQLLDVKKNQLPHHHHRALSTGSPIPSPTHS

SEQ ID NO: 28 - protein, 424 aa, Cucurbita maxima
MVCTASDLHGWKDFPKGLRVLLLDGDSNSAAEIKTKLEEMEYVVVTYCNENDALLAISSEPETFHVAIVEVMASDHDGAFKFLEAVKDLPTILISNIHCLSTMMKCIALGAIEFLQKPVSKDKLRNIWQHVVHKAFNAGGSAVPSSLKPIKESVASILHLELENDENKNQVPHELEISSGDNVDDHELLLLPEGSDKYPAPSTPQQKHGMRLVDQMNCLLEKECGEQDREESKSVETTCTAQVENSQLSDKEVIKEEENSTDGCGAASNVDHELHDRDNISSSEKNKSKACGLGNPCRMKVDWTAELHRKFVQAVEQLGVNQAIPSRILELMKVEGLTRHNVASHLQKYRMHKRHVLPKEEDGSWSSSKDPMRKNYYPHLQRPVMAYPSPYHSNHVMPVAPIGSWGHMACPSPGVQMWAPPSYP

SEQ ID NO: 29 - protein, 189 aa, Cucurbita maxima
MYGSGRQTTGVFPQDAWHCEICKRKPGRGFVEATAEVLPRLFKIKYESGTMEELLYLDMPREYHNASGEIVLDYAKAIQESVFEQLRVVRDGQLRIVFSPDLKICSWEFCARRHEELIPRRLLIPQVSHLGAAAQKYQSAIQSASSNLSTPELQNNCNMFVASARQLAKALEVPLVNDLGYTKRYVRCL

SEQ ID NO: 30 - protein, 283 aa, Cucumis sativus
SSGGGYSPYYLQEALAMLKRYLPSNEAEMDSDIDVSGKEIDSPLDAYSSDQFRMYEFKIKKCTRGRSHDWTECPFAHPGEKARRRDPRRYYYSGTACADFRKGSCVKGDACEFAHGVFECWLHPARYRTQPCKDGTSCRRRVCFFAHTPEQLRVLPQQSPRSTSSIPSYDGSPLRQAIEACAKQMPYLSSPGTSPPVSPRIESPPQSPIIKSLNRPHAPSSIKEMVASLRNLQLNKELCKLPSPSSSSSSWNVQVGSPVFGSPKESTTRSGLSTLPETSTPPR

SEQ ID NO: 31 - protein, 179 aa, Cucumis sativus
GIHRKPTEVSSQKERADGVKFRAKTEVKESSRRTQRSSSMYKGVRRRKWGKYAAEIRDPFRGRRLWLGTYNTAEEAAVAYQRKKHEFESMQSMENYSSELSGGKFEEKKIKSLVDDTAESEEIIAMFSHPSPSSVLDLCTGSLSSNGLKNVIEEFKVDQTREHTITKKSKPVQDGLSST

SEQ ID NO: 32 - protein, 253 aa, Cucurbita maxima
MAVLTLSSLPLGFRFRPTDEELINFYLRSKINGNHEEVSVIREIDVCKWEPWDLPDLSIIKTKDPEWFFFCPQDRKYPNGHRLKRATDAGYWKATGKDRKIKSGTNLIGMKKTLVFYKGRAPKGKRTNWVVHEYRATLKELDGTNPGQSAFALCRLFKKQDESIEGSNGDEAEAAISSPTTADSSPGPGDSHSEPILPLVSPSLPGRAESSDEVASETVEHPDGSAEISCFDSYNAEVRGSLFLFIFITRNSA

SEQ ID NO: 33 - protein, 221 aa, Cucumis sativus
DNNGSLALGMFMGNQITENKNMVSNQNQNPVFLGTGVVRSSQPQQQQQPLFPKPANVTFASSMNLVNNPQLTNGSGTNLVVAPKPPLHDALIQGTGIGAIGLGTRGVTVASRSPTSTISSDVITKSSIEASSFSPVPFSFGRGRRSSGALEKVVERRQRRMIKNRESAARSRARKQAYTLELEAEVAKLKEMNQELQKKQREIMETQKNQVLEKMKYQLGG

SEQ ID NO: 34 - protein, 686 aa, Cucurbita maxima
MCSGSKNKVAFSNSAMETKFQKLRDGALFSANSILLELSASDDVDGFKREVEEKDLDVDEPSCWYGRGIGSKKMGFEERTPLMIAAMYGSSKVVKYLIETGKVDINRACGSDMTTALHCASAGGSGSSLETIKLLLDGSADVDCVDANGRKPVDLIVSACRMVCYSGRKAMEMLLRGDGMAGVGDLSLFLEEDHQKISASLSAKEGSDKKEYPVDISLPDINSGIYGTDDFRMYTFKVKPCSRAYSHDWTECPFVHPGENARRRDPKKYPYSCVPCPEFRKGACPKGDSCEYAHGVFESWLHPAQYRTRLCKDETGCTRKVCFFAHRPDELRPVYASTGSGMPSPRSLSSSAADMSTMSPLALGSSSLSLPTASTPPMSPLASVSSPKNGNLWQNKINLTPPALQLPSSRLKATLSARDLDLEMELLGLEKNVSQMQHQQQLIDEISRLSAPSYWSADISRSAELKPSNLDDMFGSLDSSLLSQLQGTSLKTPISAQVQSQTGLQMRQNMNQLRASYPANLSSSPVKKPSSFGFDSSSAVAAAVMNSRSAAFAKRSQSFIDRAAVTRLPGLTGAANSAATMSSHLSDWNSPNGKLDWGMHSNDLNKLKKSASFGIRNNGMGTPTFASPVEEPDVSWVNSLVKDVPSDRFGMFGAEKRAYNLKRDINEMLPSWMEQQLYAEQEQTVA

SEQ ID NO: 35 - protein, 212 aa, Cucurbita maxima
MVSKEKSTAKKLPPLCNTNNNARELHFRGVRKRPWGRYAAEIRDPGKKSRVWLGTFDTAEEAAYAYDNAARQFRGAKAKTNFPLPDELIDVSPRKISQSPSPSSTVESSSSSSQEKTPSPEIVRSYGVARTFPFIQPQFLHQVGGGGSARPVLFMDAFVRPEFVAQGYPIRYDSARFAGEIQTKSDSLSVVDCRPAKEILNLDLNLAPPVDA

SEQ ID NO: 36 - protein, 355 aa, Cucurbita moschata
RPDRVSPWEIEPFVAPTSPSIPQSVSVKNKRLRPPLDIPDSDNSTVTTLRHPGSTQSHDDRTQLSGTAAEMKRFENHAMWNYKQTDVSSIGNSISRTPKEGSWLASPNRSVSQHRLQNLTDDRNSNYVWSTVFSGAPAAQSTCPAPHPSNPKSSDQVNDLGEKGRKTEVAPSCRLFGIDIIGHSKSPVPPEMAADQPISAPNEITDAEQNSDQPKASKERKLGLLQVPPKEIQHKQSSSTNSRSRTKVQMQGMAVGRAVDLTMLEGYGQLIDELEKMFDIKGELHPRDKWEIVFTDDEGDTMLMGDYPWQEFCNMVRRIYIWSSQDVKMMSSVSKLTMSAMECDGTVITSKSADS

SEQ ID NO: 37 - protein, 228 aa, Cucurbita maxima
MVNMLETDLCLGLPGGGGGEPETPKGNGKRGFSETVDLKLNIQSKPVVTVDLSTTQNMKSTDSEDISSKDPAKPPAKAQVVGWPPVRSYRKNAMSQKNPDGGEKGSGSAMFVKVCMDGAPYLRKVDLKTYKSYQELSNALAKMFSSFTMAGEYGAQGMIDFMNESKLMDLLNSSEYVPTYEDKDGDWMLVGDVPWEMFVDSCRRLRIMKGSEAIGLAPRAMEKCKSRS

SEQ ID NO: 38 - protein, 460 aa, Cucurbita maxima
RSDVHMPDMDGFKLLEQVGLEMDLPVIMMSADDGKNVVMKGVIHGACDYLIKPVRIEALRNIWQHVVRKRKSEWKDLEQSGSMDDGDRDQNLSEGANYSSSAYDGSWNSSKRKRDAEEELEERDDTSTLKKPRVVWSVELHQQFVIAVDQLGIDKAVPKKILELMNVPGLSRENVASHLQKYRLYLRRLSGVSPHPSNLNNAFMNPQDHPPFGSMASYNGIDLQTLLVTGQLSPQSLAALQATGLRRPTAKSSLPMALVDQTNIFSFENPKLRFGEDQTQHLNKTKPASLFHGIPTKMEPKQLANMQHPSVQTQRNMNMPLNIKSEHGGTQLMHLSQQQTVGQTLNNSTVSHLPGIPSTLRNPIISGSVTTGNGTADNSHGPRYNLVSPTSVMVNYPMSQTTEVFQEEMNSNLKVSSGVMSSYDVFSDLHMQKAHDWDYQNVSTLAFGTPHHGNFIHHRF

SEQ ID NO: 39 - protein, 368 aa, Cucurbita maxima
MDEMKVKPEESVAVGTAVCSSSSSSGSSVTPQPIEGIHDVGPPPFLTKTFEMVEDPLTDSIVSWSKARNSFIVWDYHKFSSSLLPRYFKHSNFSSFVRQLNTYGFRKVDPDRWEFANEGFLGGQRHLLRTIKRRRHSPQSFQHHQGGICVELGEFGLEGELERLKRDRSSLMAELVRLRQQHQSSREQIIAMEDRLEKSENKQKQIMTFLSKALKNPSFVQKFIHSNQGRELRGVEIGRKRRLTSGSSVENLQEESVPAAVKQEEPDMETLLAVNFEGESNGEITDPVSDGILMAAMDVGHSAPEELGFFSQLWAEDPWAGYPEEEPIIVSNQSDIDVEVEDLIAEPPDWPENLQELVDQMEFLRPKP

SEQ ID NO: 40 - protein, 201 aa, Cucurbita maxima
DNWRKYGQKQVKGSEYPRSYYKCTHPNCQVKKKVERSHEGHITEIIYKGTHTHVKPSPNRRASDSHINMQLDIPVQAGQQNAEVPLWEDSQKGTPDWMHSNLEVSSSASLGPEYGNHIETAEAIDASSTFSNDEDEDDRGTHGSITMGYEGEGDESESKKRKLDAYVTEMSGATRAIREPRVVVQTTSEVDILDDGYRWRK

SEQ ID NO: 41 - protein, 203 aa, Cucurbita maxima
KLAELWSSDPKRAKRILANRQSAARSKERKARYIQELERKVQTLQTEATTLSAQLTLFQRDTTGLSTENTELKLRLQAMEQQAQMRDALNEALKKEVERLKIATGEMMSPSESFNLGMHHMAYAPSSFIQLSQQPGSAGPQNIQMPPYNHSPSNMSSHPLHPSDSHSLSEVLQSDPLGRLQGLDISSKGSSLVKSEDPSLSAS

SEQ ID NO: 42 - protein, 213 aa, Cucurbita maxima
VNATNSSAVIDSYHNTSSGAPKTVDDVWREIVSGERKELKEEVTDELITLEDFLVKTGAAPVEDVKLPQTERLSGGIFSFDSIPGSSFQAVEKVEGSIVGFGSGVDLVGSGGSVGRGKRGRAALEPLDKAAEQRQRRMIKNRESAARSRERKQAYQVELESLVAKLEEENERLLREKAERSKERHKQLMERVIPVVEKRRPPRGIRRVNSMKW

SEQ ID NO: 43 - protein, 223 aa, Cucurbita maxima
VWYGVPGNGAGKLEEAMRKHLPDLFDEQPDLLHKLVTQLSPSILKSEGVPVYRCIQNPGEFVLTFPRAYHSGFNSGFNCAEAVNVAPVDWLPHGQIAVELYREQGRRTTISHDKLLLGAAREAVRAHWELNLQKRNTLDNLRWNNVCGKDGVLARAFKTRVELECARRNIPCGSSRAMKMESNFDASNERECSSCLFDLHLSAVGCRCSPDKYVCLNHANQLS

SEQ ID NO: 44 - protein, 144 aa, Cucurbita moschata
FRRQDVPLLQQYLNNHFREFRHIHAGPVPQVFHPVHDQSFYLTLEHKRKLKEEYGIEPWTFVQNLGDAVFIPAGCPHQVRNLKSCIKVAMDFVSPENVGECIHLTEEFRRLPSNHWAKEDKLEVKKMSVHAMKATIACLKEKCK

SEQ ID NO: 45 - protein, 248 aa, Cucurbita moschata
KTTFLSDKTKLLKNKKLNPSPWPPSSKSLHKGRVQNSVQHFSCPSKECGSCSESLLELRCIFPLSWTKELEVNAEEIVCSYDFPESVDSSSNCTLCFGEDHKVDELEEFQKVAVREDSNDNYLYYPNLFRIRLDDLDHFQRHWIRGHPVIVRNVLETSDLTWDPVVMFRTYLERIISRYENGTSLPEASNNLDWCEVEIGIRQYFMGSLKGKTHTNTCNNMLKLKGWLSSHLFQEKFPAHYAEIMRIL

SEQ ID NO: 46 - protein, 223 aa, Cucumis sativus
ADLQLPPGFRFHPTDDELVTHYLCRKCASQPISVPIIAEIDLYKYNPWDLPERALYGEKEWYFFSPRDRKYPNGSRPNRSAGSGYWKATGADKPIGRPKAVGIKKALVFYSGKAPKGEKTNWIMHEYRLADVDRSARKKNSLRLDDWVLCRIYNKKGAIEKQNPPEMNTIGFFENEEQEEKPEILNDRAISGRIPSASPLQGPPSSGVVNDYVYFDPSDSIPR

SEQ ID NO: 47 - protein, 186 aa, Cucumis sativus
  VARIANT (1)...(186): Xaa = Any Amino Acid
SHPQRKNTSNLTYTTLYIYIIHTRTYTVMDFSDASSSSHRSTLSDDELLLASRYPKKRAGRKKFKETRHPIYRGVRLRNSGKWVCEVREPNKKTRIWLGTFPTAEMAARAHDVAAIALRGRSACLNFADSASTLHIPASVDPKDIQRAAAEAAEAFRPQDDELTPAVVDXEGFYLERKWSLGCPGC

SEQ ID NO: 48 - protein, 180 aa, Cucurbita maxima
LANCLILLAQGRTGDCASVLVQHNQSLFAYQCKTCDRCFPSFQALGGHRASHKKPKISNSLQTHDPQFHLSLQLSTGRPPASFAAGDVVKSKVHECSICGAEFSSGQALGGHMRRHRALTSTASVASRGATATPQLQELMIKKERNVLELDLNLPAPEDDRHRTAVAVFSAASSLVDCHY

SEQ ID NO: 49 - protein, 223 aa, Cucurbita maxima
MAPVGLPPGFRFHPTDEELVNYYLKRKISGQVIELDIIPEVDLYKCEPWELSEKSFLPSRDPEWYFFGPRDRKYPNGFRTNRATRAGYWKSTGKDRRVTSHQRAIGMKKTLVYYRGRAPQGIRTDWVMHEYRLDDKDCEDSSGIQDSYALCRVFKKNGICSEVEEQLSGQSSSSSLSFIDNSNSTSQTLVNDYETLSPDVLMPSPSSSCVEEEERTIHGCSSL

SEQ ID NO: 50 - protein, 172 aa, Cucurbita maxima
MENYQMFFPCSNGGGLSAYSQLDISSGTASDMFRNFHGGDPQASGVLGLKTEVVTAAVEADRNCGGSANKKGEKKVRKPRYAFQTRSQVDILDDGYRWRKYGQKAVKNNKFPRSYYRCTHQGCNVKKQVQRLTKDEGVVVTTYEGMHTHSIDKPTDNFEQILSRMQIYSTPF

SEQ ID NO: 51 - DNA, 1938 bp, Arabidopsis thaliana
atggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaagcctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaacttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcctgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatga

SEQ ID NO: 52 - DNA, 1725 bp, Arabidopsis thaliana
atggattccggtgacgcgacatctttgcttttgacgaaaattcgaagcttggagccagattatgctcctaagattattggaaactctccgtcttctccttcttctacctctccttggtcattcaacaactgtatcaacggtaataatgggaataacccccacatttcccctaaacacactccgatctcgaaaccctttagctctcaccaaagcaatggactttctgctacacattctggtagtgctgacgctgctggtggtgctgatttacttgatgatcagcagcttaatgattgcctttcgtttctcgacgattcttgttctaaaaccgaggatcttgtggatcctagcattcctttggattactctgtagatggtgatggtgaaacccatctgcacaggaggagtttctcttgtgatgcgtcttttgtgtccggagatgatggatttggtggtggatgcaaaccatgtgtgtattttagtagaggtttgtgcaagaatggagaaagctgcaagtttatccacggtggatatccggataatatggatggtaatggcattgtcgctgactcgcctaggaaaatggagaactttgttaggcagcacgaggagatgatgaggctgaaattggcttaccagcagcagaggttggcttctcaaatcctgggtcgggctccccagttgccatacgagaaaagaatggactttctcttgcagcagcatgctcaaagagatggtggactgccttttggtgatgaaagattttggagcagcagcccaggacggcttgagaggatggagctggcaatgcatttaggtgatcagtcaaattcggcatctagacagatttacttgacattcccagctgacagcacgtttaaggatgaggatgttgctacatatttcagcctctttggaacagtccaagatgtgcggatcccataccaacagaagcgtatgtttggctttgtttcatttgctcatcccgagacagtgaaagttgtactagctagagggaatccccatttcatttgcgactcacgggttcttgtcaaaccttacaaagaaaaaggcaaagtcttggacaagaagcaacagcaactgctacaacagcagattgagcgaggaaattactccccgtgctccagtccatctgggattgatcctagagaacagtctgatttccaccttggttcaaagatgttgtatgagagacgtgagatgatgagaaggaaaatagagcaggctgatctcctgagggctattgaactcgaaagaagacgtttcattaatttacagcttcctgagttcaagaatagtgtaacgctgaatcatcaccgtagcttttctgtggggtctcctggttatttttcatctgccggcaatcaaagccctgattttcaatctgaacttaacggtgcagatgctttaaaagtaactgatgataccttggagctgcatccttacccagtagtcaacccaatgagtgttaacaatagctactcaaacggtgcaaaagaagagactaacaagagtgaattgcttgatcccgattctggaagcaccattgagcttgttcttcctagtaacctcttcccttctgcatcatctaccgatgatcacaaaaccgatgattctgctgaaactaatgcaaaagttggagtctcctctactaatgaaaatgaccatgaaccaccagtcactaccaataatctgatgcagtag

SEQ ID NO: 53 - DNA, 1608 bp, Arabidopsis thaliana
atggtcattaccgctaacgatttatcaaaatgggaaaattttcctaaaggacttaaggttcttcttctcctcaacggctgtgacagcgacggagatggctcctcagccgccgagactcgatcagagctcgaatcaatggactatatcgttactacattcaccgatgaaactgaagcactctctgcggttgtcaagaacccggagagcttccacattgccatcgtcgaggtgaatatgagcgctgagagtgagagtttcaagtttcttgaggctgccaaagacgttcttcctactataatgatttcaaccgatcattgcatcactactacaatgaaatgcatagcgcttggtgcagttgagttcctacaaaaaccgctctcaccggagaaattaaagaacatttggcagcatgttgttcataaggcattcaatgatggtggaagtaatgtttcgatatcacttaagccagtgaaagaatccgttgtctcgatgcttcatcttgagaccgacatgacaatcgaggagaaagatccagcgccatcaacaccgcaattgaaacaagattcacggttactagacggtgattgccaagagaacataaatttctcgatggaaaatgtaaattcctcgaccgagaaagataacatggaagatcatcaagacatcggtgaatctaaatcagtcgacactacaaaccgcaaattagatgacgacaaagtggttgtcaaagaagagagaggagacagtgaaaaagaagaagaaggtgaaaccggagatctcataagcgagaagacagattcagttgatattcataagaaagaagatgagactaaaccgattaataaatcatccgggatcaagaacgtgtctggtaacaaaactagtcgaaagaaggtggattggacaccagagctgcacaagaagtttgtgcaagcagttgagcaactcggcgttgatcaagcgataccctcgcggattcttgagttgatgaaagtaggcaccttaacaagacacaatgtagctagtcaccttcagaaatttcggcagcataggaagaatattcttccaaaggatgatcataaccatagatggatacaatctagagagaaccatagaccaaatcaacgtaattataacgtttttcaacagcaacaccgtcccgtgatggcttatcccgtttggggtcttcccggtgtttatccgccaggagcgattccacctttgtggccaccgccgctgcagtccattggtcaaccacctccgtggcattggaaaccaccttatccaacggtgagcggtaatgcatggggttgtccggttggaccgcctgtgaccggatcatatattactccttcgaatactaccgccggcggatttcaatatcccaacggagctgaaaccggcttcaaaataatgccggcgagtcagccggacgaggaaatgttagatcaagtggttaaagaagcgataagcaaaccgtggctgccgctaccgctcgggctaaaaccgccgtccgcggagagcgttttggctgagctaacgcgtcaaggcatctcagccgtcccttcttcttcttgtctaatcaacggctctcatcgtctccgctga

SEQ ID NO: 54 - DNA, 2634 bp, Arabidopsis thaliana
atggtaccatcagagccgcctaatcctgttgggggtggtgaaaatgttccgccttcgatattaggaggacaaggaggagctcctcttccttctcaaccagcatttccttcacttgtctctccgcgtactcagtttggtaacaatatgagtatgagtatgcttgggaatgctccaaatatatcttctcttctcaataatcagtcttttgtaaatggtatccctggttctatgatttctatggatacaagtggtgctgagtctgacccgatgtctaacgtcgggtttagtggtttgtcgtcttttaatgcgtcgagtatggtgtctccgcgctcatcaggtcaagttcagggtcagcagttttcgaatgtttcggctaaccagttgttggctgagcaacaacggaataagaaaatggagacgcagagttttcaacatggtcagcagcagtcaatgcagcagcagttttcgacagtgcgtggtggtggattagcaggtgtgggacctgttaagatggagcctggtcaggtttcgaatgatcagcagcatggtcaagtacaacagcagcaacagaaaatgttgagaaacctagggtcagttaagttggaaccgcagcaaattcaggccatgagaaatttggcccaagtgaaaatggaacctcaacattctgagcagtcattgtttctccaacaacagcagaggcaacaacagcaacaacaacaacaacaatttcttcaaatgccggggcaatctccgcaggctcaaatgaacatatttcagcagcagagacttatgcaacttcaacaacagcaactcttgaaatctatgcctcaacagcgtcctcaattaccacagcagttccaacagcagaatttacctctaaggccacctctgaaaccagtgtatgaacctggcatgggtgctcagcgtcttacacagtatatgtacagacaacaacataggcctgaagacaataatatcgagttctggagaaaatttgtagctgagtactttgctcctaatgccaaaaagagatggtgcgtctctatgtatggcagtggcaggcaaacaacaggcgttttccctcaggatgtgtggcactgtgagatatgtaaccgaaagcctggacgtggttttgaggcaaccgccgaagtccttccgcggctgtttaagattaagtatgagagtgggacgttagaagaactgttatatgtagatatgccaagggagtcccagaattcatctggccaaattgtcctggagtatgcaaaagcaacacaagagagtgtctttgagcatcttcgggttgttcgtgatggccaacttcgaatagtcttctcgccagatcttaagatattctcctgggaattttgtgctcggcggcatgaagagcttattccacgaagacttttgataccgcaggttagtcagcttggatcggcagctcagaaatatcaacaagctgctcaaaatgcaacaacagattctgctcttccggagctacaaaataattgcaatatgtttgttgcatctgctagacaattggcaaaggccctggaagtaccacttgtgaatgatttgggatacacaaagagatatgttcggtgtttgcagatctcagaggtggtaaatagtatgaaggacctgatagattatagcagagaaacacgaacaggaccaatcgagagtttagccaagtttcctcggagaacaggcccttcatctgcactgcctggtccttctcctcagcaagccagcgaccagcttaggcagcagcagcaacaacaacagcagcagcagcaacagcaacaacaacaacaacaacaacagcagcagcagcaaacagtttcccagaatacaaacagtgatcaaagtagtaggcaagttgcactaatgcagggtaatccaagcaatggtgtaaattatgcctttaatgcagcctctgcatccacttccaccagcagcatcgcagggctcatccaccagaattcaatgaagggaagacatcagaatgctgcttacaatcctccaaacagcccctatggaggaaactctgttcagatgcaatcacctagttcctcgggtaccatggtgccatcatcatcgcagcaacaacacaacctgccaacatttcagtctccaacatcctcatctaataacaataatccctctcaaaacgggataccatctgttaatcacatgggttccacaaactcaccagcaatgcaacaggcaggtgaggttgatggaaacgagtctagctcggtgcagaagatactgaatgaaatcctgatgaacaaccaagctcataataatagctcaggaggaagcatggttgggcatgggtctttcgggaatgatgggaagggtcaagctaatgtaaatagttctggtgttttactgatgaatggccaagtgaacaacaacaacaacacaaatattggaggtgctggtgggtttggtggtgggattggtcaatccatggcagcaaacggaatcaataatataaacggtaacaatagtctcatgaacggaagagttgggatgatggtgcgggatccaaacggtcaacaggatttaggaaaccaacttttaggagcagtgaatggtttcaacaattttgattggaacgcgtga

SEQ ID NO: 55 - DNA, 1080 bp, Arabidopsis thaliana
atgatgatcggagaatctcatcgtggttttaatccaacggttcatattcctccatggccactttctgaagatctaacggtgtctgatatttacggaagtccagacggaggaagtagtatgatggaagctttggctgagttacaacgttatcttccgtcaaacgaaccggatccggattcagatccggatctctcgggtccggattcaccaatcgatgcttatacatgcgatcattttcggatgtatgagtttaaagtgagacgttgtgctcgtggccggagccatgattggacggagtgtccttacgctcatcccggagaaaaagctcgccgtcgtgatccgaggaagtttcattactccggtacggcgtgtcctgagtttcgtaaaggttgttgcaagagaggagacgcatgtgagttttctcatggtgtttttgagtgttggcttcacccggcgcgttaccggactcagccgtgtaaagacggtggtaactgtcgccgtcgtgtttgtttctttgctcattcgccggatcagattagggttttgcctaatcaaagccctgatcgtgttgattcgttcgacgttttgtctcctacgattcgtagagcgtttcagttttcgatttctccgtcgtctaactcgccgccggtgagtccacgaggtgactcggactcgtcgtgttcgttactgagtcgttcactcgggtctaatctgggaaacgacgtcgttgcgtctctcaggaatctgcaacttaataaagtgaagtcttctctttcgtcgtcatacaacaatcaaatcggaggatacggatccggattcgggtcgcctcgtggatcggttttgggtcctggtttccgtagcttaccaactacaccgacccgacctggttttatgaacatttgggagaatggcttggaggaagaaccggcgatggaacgggtcgagtcgggtcgtgaactgcgagcgcagctgttcgagaagctgagcaaagagaattgcatgggtcggattgaaccggatccggatcagggagcgggtgatactcctgatgtcgggtgggtctctgacttggttatgtga

SEQ ID NO: 56 - DNA, 789 bp, Arabidopsis thaliana
atgtgcggaggagctgtaatttccgattacatagcgccggagaagattgcgagatcatctggaaagtcttcctggagaagtaatggcgtctttgactgctcaatctacgatttcgatggaaatttcgatgaattagagtccgatgagccatttgtcttctcctctactcacaaacatcatgcttcaggctcagcatcagatgggaagaagaaacagagcagtcggtacaaaggaatcagaagaaggccttggggaagatgggcggctgagatacgtgatccaatcaaaggagttcgagtttggctcgggactttcaacacagctgaagaagctgcaagagcttatgatcttgaagctaagagaatccgtggagccaaagctaagctcaatttccctaacgaatcctctggaaagaggaaagccaaggctaagactgtgcaacaggtagaggagaatcatgaggctgatcttgatgtggcggtggtaagctcagcgcctagtagtagctgtcttgatttcttgtgggaggagaataatccggacacgcttctgattgatacacaatggctcgaagatatcatcatgggcgatgcgaataagaaacatgaacctaatgatagtgaagaagccaacaacgttgatgcttctctgctttctgaagagcttcttgcttttgagaaccagaccgaatatttctcgcagatgccttttacggagggaaactgtgattcctcaacgtctctgagtagtctctttgatggaggcaatgacatgggtctatggtcctga

SEQ ID NO: 57 - DNA, 1914 bp, Arabidopsis thaliana
atgacgacggagcaagctttgttgtctatggaagctttacctttaggtttcagattcagaccaacggatgaagaactcatcaatcattacctaaggttaaaaatcaacggccgtgatttagaggttagagtcatccctgagatcgatgtttgcaagtgggaaccatgggacttacctgggctatcggtgataaagacagatgatcaagaatggttctttttttgtcctcgtgatcgaaagtatccgagtggtcatcgttctaatagagctactgatattggttactggaaagctactgggaaagatcgaactattaagtctaagaagatgattattggtatgaagaagactcttgttttctatcgtggaagagctcctagaggagagcgtactaattggattatgcatgagtatcgtgctacagacaaggaactagatggtactggacctggtcagaatccgtatgttttgtgtcgcttgttccacaagcctagtgatagttgtgatcctgcacactgtgaggaaatagagaaagttaattttactccaaccaccaccactagatgctctcctgatgacacatcttctgaaatggtccaagaaacagctacatctggtgtacatgctctagatagatcagatgacactgagaggtgtttaagtgacaagggcaataatgatgtgaaacctgatgtttcagtgataaacaatacttctgtcaatcacgctgaaacttctcgtgccaaagaccgtaatttgggcaagacgttagtagaggaaaatccacttctaagggacgttccaactcttcatggacccatcttgagtgagaaatcatattatccaggacagtcaagcatcggttttgctacatctcacatggattctatgtattctagtgattttggaaactgtgattatgggctacattttcaagatggtgcctctgaacaagatgcatctttaacagatgtcttggatgaagtattccataaccataatgaatcctctaatgacaggaaagactttgtacttccgaatatgatgcattggcctggtaatacaagactgttgtctactgagtacccatttctcaaagattctgttgcttttgttgacggcagtgctgaagtttccggctcacagcaatttgttcctgacattttagcttctagatgggtcagtgaacagaacgttgatagcaaggaggcagtagagattctatcttcaaccgggtcctctcggaccttgacgccacttcataacaacgtttttgggcaatatgcttcatcgtcttacgcagctatcgatccatttaactataatgtcaatcagcctgaacagtcatcctttgagcaaagccatgttgaccgcaacattagtcccagtaacatttttgagttcaaggctaggtctcgagagaatcagagagatctggactctgttgtggaccaaggcactgctcctagaagaattcggctgcagatcgaacagccattgacgccagttaccaacaagaaagagagagatgcggacaactatgaagaagaagatgaagtacaatctgccatgtccaaggtcgtagaggaagaaccggctaatttaagtgctcaggggactgctcagaggagaatccgcctgcagacgagattgaggaagcctctcataaccctaaacaatacaaaaagaaactcaaatggcagagaaggagaagcaagccataggaaggaaaaagaagatatatcatcatcatcatcatggcagaaacagaagaagagcttggtgcagtttagtagtgtggtgataatagtggcggtgatagttgttttagtagaaatatggaaagagtcaagagatgcgaaatgtagcttcttgtttcatcaattagattccttcaaaggcatgtttacttga

SEQ ID NO: 58 - DNA, 1365 bp, Arabidopsis thaliana
atggggtctagattaaacttcaagagctttgttgatggtgtgagtgagcagcagccaacggtggggactagtcttccattgactaggcagaactctgtgttctcgttaacctttgatgagtttcagaactcatggggtggtggaattgggaaagattttgggtctatgaacatggatgagctcttgaagaacatttggactgcagaggaaagtcattcaatgatgggaaacaataccagttacaccaacatcagcaatggtaatagtggaaacactgttattaacggcggtggtaacaacattggtgggttagctgttggtgtgggaggagaaagtggtggttttttcactggtgggagtttgcagagacaaggttcacttaccttgcctcggacgattagtcagaaaagggttgatgatgtctggaaggagctgatgaaggaggatgacattggaaatggtgttgttaatggtgggacaagcggaattccgcagaggcaacaaacgctgggagagatgactttggaggagtttttggtcagggctggtgtggttagggaagaacctcaaccggtggagagtgtaactaacttcaatggcggattctatggatttggcagtaatggaggtcttgggacagctagtaatgggtttgttgcaaaccaacctcaagatttgtcaggaaatggagtagcggtgagacaggatctgctgactgctcaaactcagccactacagatgcagcagccacagatggtgcagcagccacagatggtgcagcagccgcaacaactgatacagacgcaggagaggccttttcccaaacagaccactatagcattttccaacactgttgatgtggttaaccgttctcaacctgcaacacagtgccaggaagtgaagccttcaatacttggaattcataaccatcctatgaacaacaatctactgcaagctgtcgattttaaaacaggagtaacggttgcagcagtatctcctggaagccagatgtcacctgatctgactccaaagagcgccctggatgcatctttgtcccctgttccttacatgtttgggcgagtgagaaaaacaggtgcagttctggagaaagtgattgagagaaggcaaaaaaggatgataaagaatagggaatcagctgcaagatcccgcgctcgcaagcaagcttatacgatggaactggaagcagaaattgcgcaactcaaagaattgaatgaagagttgcagaagaaacaagttgaaatcatggaaaagcagaaaaatcagcttctggagcctctgcgccagccatggggaatgggatgcaaaaggcaatgcttgcgaaggacattgacgggtccctggtag

SEQ ID NO: 59 - DNA, 1794 bp, Arabidopsis thaliana
atgtgcggtgcaaagagcaacctttgctcatctaaaaccctaacagaagtcgaattcatgaggcagaaatcagaagacggagcttccgccacgtgtctcctcgaattcgccgcctgtgatgatctttcatcgtttaagagagagatcgaagagaatccatcggtggagattgatgagtcagggttttggtattgcagacgggtcgggtctaagaagatgggttttgaagaaagaacaccacttatggttgctgctatgtatggaagcatggaagtgttgaattacataattgccacaggaagatccgatgtgaacagagtttgcagtgacgagaaagtcactgctcttcactgtgcagtttctggctgttctgtttctatcgttgagatcatcaagatcttgcttgatgcttctgcttcacctaattgtgttgacgctaatgggaacaaaccggttgatttgttggctaaagattctcggtttgttcctaaccagagtagaaaggcggttgaggttttactgaccgggattcatggttcggttatggaagaagaggaggaggaactgaagagtgttgtgactaagtatccagctgatgcatcacttcctgatattaacgaaggtgtttatggaactgatgattttaggatgtttagctttaaggttaagccatgttctagggcttattcacatgattggactgaatgtccttttgttcatcctggtgagaatgcaaggaggagagatcctaggaagtatccttacacttgtgtgccttgtcccgagtttcgtaaagggtcttgtcctaaaggagattcgtgtgagtacgcgcacggtgttttcgagtcttggcttcacccggcgcagtataggacacggctttgcaaagatgagactggttgtgctaggagagtttgtttctttgctcatagacgggatgagttaagaccggttaatgcttctactggttctgcaatggtttcaccaaggtcgtctaatcagtctcctgagatgtctgttatgtctcctttgacgctgggatcatcgccaatgaactctcctatggctaatggtgttcctttgtctccaagaaatggtggtttatggcagaacagagttaatagccttacaccaccaccgttgcagcttaatggtagcagattgaagtcgactttgagtgctagagatatggatatggagatggaacttaggtttcgcggtttggataaccggagacttggtgatctcaagccatccaacctcgaagagactttcggatcatatgactcagcttctgtgatgcaacttcaatcaccaagcaggcattctcagatgaaccactatccgtcttcacctgtgaggcagcctcctcctcatggattcgaatcttcagcagccatggcagctgcagtgatgaatgcaagatcctcagcgtttgcgaaacgcagcttgagtttcaaaccagctccagtagcttctaatgtctccgattggggatcaccaaatgggaagcttgagtggggaatgcaaagagatgagctgaacaagttgaggagaagtgcctccttcggcattcatggaaacaacaacaacagtgtgtcacgccctgctagagactacagtgacgagccagatgtgtcgtgggtgaactcactggtgaaagagaatgcaccagagagagtgaatgagagggttgggaatacggtgaatggtgcagcgagtagagacaagtttaagctgccgtcgtgggcagagcaaatgtatatagaccatgagcagcagattgtggcataa

SEQ ID NO: 60 - DNA, 669 bp, Arabidopsis thaliana
atggccaagatgggcttgaaacccgacccggctactactaaccagacccacaataatgccaaggagattcgttacagaggcgttaggaagcgtccttggggccgttatgccgccgagatccgagatccgggcaagaaaacccgcgtctggcttggcactttcgatacggctgaagaggcggcgcgtgcttacgatacggcggcgcgtgattttcgtggtgctaaggctaagaccaatttcccaacttttctcgagctgagtgaccagaaggtccctaccggtttcgcgcgtagccctagccagagcagcacgctcgactgtgcttctcctccgacgttagttgtgccttcagcgacggctgggaatgttcccccgcagctcgagcttagtctcggcggaggaggcggcggctcgtgttatcagatcccgatgtcgcgtcctgtctactttttggacctgatggggatcggtaacgtaggtcgtggtcagcctcctcctgtgacatcggcgtttagatcgccggtggtgcatgttgcgacgaagatggcttgtggtgcccaaagcgactctgattcgtcatcggtcgttgatttcgaaggtgggatggagaagagatctcagctgttagatctagatcttaatttgcctcctccatcggaacaggcctga

SEQ ID NO: 61 - DNA, 1917 bp, Arabidopsis thaliana
atggcaaatcgcggaggtgaatatctgtacgatgagttatggaaattatgcgcgggacctcttgttgatgttcctcaagctcaagaaagagtttattattttcctcaaggtcacatggaacaactcgaagcgtcaacgcaacaagtcgacttaaatacgatgaagcctctttttgttcttcctcctaagattctctgcaatgttatgaacgttagtcttcaggcggagaaagatacggatgaggtctatgctcagattactttgatccctgttggaactgaagttgatgaacctatgagtcctgatccctctcctcctgagttgcaaaggccgaaagttcactctttcagcaaggttttgacagcgtctgatacaagcacccatggtggcttttctgttctaaggaaacatgccacggaatgtcttcctccgctggatatgactcagcaaaccccgacccaggagttagtagccgaagatgtgcacggttatcagtggaaattcaagcatatttttagaggccaaccacggaggcatctattgacgacagggtggagcacctttgttacatcaaagagattggttgctggggacacctttgtattcctgagaggggagaacggagagttgcgagttggagtcagacgtgctaatcttcaacagagcagtatgccttcatccgttatatcaagtcatagtatgcatctgggagtgcttgctactgcacgccatgctactcaaacgaaaactatgttcattgtatactataaaccaaggacaagccaattcatcattagcttgaacaaatatctagaagccatgagcaataagttctctgtagggatgagatttaagatgcgttttgagggagaggattcccctgaaagaagatattctggcacggttattggtgtgaaagactgctcccctcactggaaagactcaaaatggcgatgcttagaagttcattgggatgagcctgcatcgatttcaagacccaataaggtttcaccatgggaaattgaaccgtttgtaaattcagaaaacgttcccaaatcagttatgctgaagaacaaaaggccccgtcaagttagtgaagtatctgcacttgatgtaggcataacagcttcaaacctttggagctctgttttgacgcaaccccatgagtttgcacaatcgtgcatcacctcacagtggagttctcctcagcaatgtcatcgtgatgcaaatgaggatgctaagaaatctgactggctaaataactcttactctgtgtcaaatgtagcaaaagactcaacactgaacgaccaaatggtttccccagtcgagcagaagaagcctgagacaaccgctaattatagattatttggaattgatctgatgagttcctccctagcggttcctgaggagaaaactgcacccatgcgaccaatcaacatatccaaaccgactatggacagccactcagacccaaaatcagagatttcaaaagtatcagaagagaaaaagcaggaacctgcggagggatcaccaaaagaggtccaaagcaagcaaagcagttctacaagaagccgtaccaaggtgcagatgcaaggcgtacctgtgggcagggctgtggatttaaatgcgctaaaggggtacaacgagctcatagatgacattgagaagctgtttgacataaaaggggaactgcggagtcgcaatcaatgggaaatagtgttcacagacgatgagggagatatgatgcttgtcggtgatgacccatggcctgagttctgcaacatggtgaagagaatattcatatggtcgaaagaggaagtgaagaaaatgacgcctgggaaccaactccggatgctgttaagggaagttgaaacaacactaacaacaacttccaaaacagataatcattccaactaa

SEQ ID NO: 62 - DNA, 732 bp, Arabidopsis thaliana
atgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttga

SEQ ID NO: 63 - DNA, 1863 bp, Arabidopsis thaliana
atggcattgtctctgctccggaagaacaaacatggattcgatatagtaatcagtgatgttcatatgcctgacatggacggtttcaagcttcttgagcatgttggtctagagatggacttacctgttatcatgatgtctgcggatgattcaaagagtgtggttctaaagggagtaacgcacggtgcggttgattaccttatcaagcctgtacgtatggaggcacttaagaacatatggcagcatgtagttaggaagaggagaagtgaatggagtgtaccggaacattctgggagcattgaggagactggcgagagacagcagcagcaacatagaggaggtggtggtggtgcagctgtttctggtggagaggatgcggtggatgataactcatcctcggttaacgaaggtaacaattggaggagcagttcacggaagaggaaagacgaggaaggagaagagcaaggagatgataaggacgaagatgcgtcgaatttgaagaaaccgcgtgtcgtctggtctgttgaattgcatcagcagtttgttgctgctgttaatcagctcggcgttgagaaggcggttcctaaaaagatcttagagctgatgaatgttcctggtctaacccgagaaaacgtagcaagtcacctccagaaataccggatatatctaagacggcttggaggggtatcgcagcaccaaggcaatcttaacaactcgtttatgacgggtcaggatgcgagcttcggacctctttcgacattgaatgggtttgatcttcaagcactagccgtcacaggtcagttacctgcacagagtcttgcacagcttcaagccgctggtttaggccggcctgcgatggtctctaagtcaggtttgccggtttcctccattgtggatgagagaagcatcttcagctttgacaacacgaaaacaagatttggagaagggcttgggcatcacgggcaacaaccccaacagcaaccacagatgaacttacttcacggtgtccccacgggtttacaacagcagcttcctatgggtaatcgaatgagtattcaacaacagattgctgctgttcgagctggaaatagtgttcaaaacaacggaatgctgatgcctctagcgggtcagcagtctttgcctcggggaccaccgcctatgctaacctcttcgcaatcatccatcaggcagccgatgttatcaaaccgcatttccgagagaagtggtttctctggaaggaacaatatccccgagagcagcagagtgttaccgacaagttacactaatctcacaacacaacactcatcaagctcgatgccttataacaacttccaaccagaacttcccgtgaacagtttcccgctggcaagtgcaccagggatatcagtaccggttcggaaagccacttcttaccaggaagaggttaacagctccgaagcgggtttcactacgccgagctacgacatgttcaccaccagacagaatgattgggatctgaggaatattggaatagcctttgactcacatcaggactcagaatccgctgcgttttccgcttcagaagcctactcttcttcgtccatgtcaagacacaacacgacagttgcagccaccgagcatggccgaaaccaccagcagccaccatcgggaatggtacagcaccatcaggtttatgcagacggaaacggtggttcagtgagggtgaaatcagagagagtggctacggatacagcaacaatggcgtttcacgagcagtatagtaatcaagaagatcttatgagcgcacttcttaagcaggaagggattgcaccggttgatggcgaattcgactttgacgcatactccatcgataacattccggtttga

SEQ ID NO: 64 - DNA, 1038 bp, Arabidopsis thaliana
atggaagaactgaaagtggaaatggaggaagaaacggtgacgtttactggttctgtagcggcttcttcatctgtaggatcctcttcctctcctagaccaatggaagggcttaacgaaacagggccaccaccgtttctgactaagacttacgaaatggtggaagatccggcgacggacacggtggtttcttggagtaatggtcgtaacagctttgtggtgtgggattctcataagttctcaacaactctccttccacgttacttcaagcatagcaatttctcaagttttattcgtcagctcaatacttatggattcagaaagattgatccagatagatgggaatttgcaaatgaagggtttttagcaggacaaaagcatctcttgaagaacatcaaaagaaggaggaacatgggtttgcagaatgtgaatcagcaaggatctgggatgtcatgtgttgaggttgggcaatacggtttcgacggggaggttgagaggttgaagagggatcatggtgtgcttgtagctgaggtagttaggttgaggcaacagcaacacagctccaagagtcaagttgcagctatggagcaacggttgcttgttactgagaagagacagcagcagatgatgacgttccttgccaaggcgttgaacaatccgaactttgttcagcagtttgcggttatgagtaaagagaagaagagtttgtttggtttggatgtggggaggaaacggaggcttacttctactccaagcttggggactatggaggagaatttgttacatgatcaagagtttgatagaatgaaggatgatatggaaatgttgttcgctgcagcaatcgatgatgaggcgaataattcgatgcctactaaggaggaacaatgtttggaggctatgaatgtgatgatgagagatggtaatttggaagcagcgttggatgtgaaagtggaagatttggttggttcgcctttggattgggacagccaagatctacatgacatggttgatcaaatgggttttcttggttcggaaccttaa

SEQ ID NO: 65 - DNA, 2064 bp, Arabidopsis thaliana
atggctggttttgatgaaaatgttgctgtgatgggagaatgggtgcctcgtagtcctagtcccgggacacttttctcctctgctattggagaagagaagagctcgaaacgtgttcttgaaagagagttatctttgaatcatggtcaagttattggtttagaagaagacactagtagtaatcataacaaggattcttcacaaagcaatgtttttcgaggtggtctcagtgaaagaattgctgcaagagctggatttaatgctccaaggttgaacactgagaatatccgcaccaacaccgacttttccattgactctaaccttcgatctccttgcttaaccatctcttctcctggccttagccctgcaacactcttggaatctcctgttttcctttctaacccattggctcaaccttctccaactaccgggaaatttccatttcttcctggtgttaatggtaatgcattgtcttctgagaaagcgaaagacgagttctttgatgatattggagcatcattcagcttccatcctgtttcaagatcatcttcctctttcttccaaggcacaacagagatgatgtcagttgattatggtaactacaacaatagatcttcttctcatcaatccgcagaagaagtaaaacctggctctgaaaacatagaaagctccaatctttatgggattgaaactgacaatcaaaacgggcagaacaagacatctgatgtcactacaaacaccagtcttgaaaccgtggatcatcaagaggaagaagaagagcaaagacgcggtgattcgatggctggtggtgcgcctgcagaggatggatataactggaggaaatacggacaaaagttggtcaaaggaagtgagtatccgcgaagctattacaagtgcacaaacccgaattgtcaggtgaagaagaaagttgagagatcaagggaaggtcacatcacagagattatatacaaaggagctcataatcatcttaaacctccacctaatcgccgctcagggatgcaagtagatggaactgaacaagttgaacaacaacaacaacagagagattctgctgcaacgtgggttagttgtaataacactcaacaacaaggtggaagcaatgagaacaatgtcgaagagggatctacgagattcgagtatggaaaccaatctggatcaattcaagctcaaaccggaggtcaatacgagtcaggtgatcctgtggttgtggttgatgcttcttcaacattctctaatgatgaagatgaagatgatcgagggacacatggaagtgtttctttgggttacgatggaggaggaggaggtgggggaggagaaggagatgaatcagagtcgaaaagaaggaaactagaagcttttgcagcagagatgagtggatcaacaagagccatacgtgagccaagagttgttgtgcagacaacgagtgatgttgacattcttgatgatggttatcgctggcgaaaatatggtcagaaagttgtcaaaggcaatccaaatccaaggagttattacaaatgcacagctccaggatgtacagtgaggaaacatgttgaaagagcttctcatgatctcaaatccgttataacaacttacgaaggcaaacataaccatgacgtccccgctgcacgcaacagcagccacggaggcggtggtgatagtggtaacggtaacagcggcggttcagccgcagtttctcaccattaccacaacggtcatcactcagagccgccacgtgggagattcgacagacaagtcacaactaacaatcagtctccttttagccgtccctttagctttcagccacatttgggtcctccttctggtttctccttcggtttaggacaaaccggtttggttaatctttcaatgcctggtttagcgtatggtcaagggaaaatgccgggtttgcctcacccgtatatgacacaaccggttgggatgagtgaagcaatgatgcagagagggatggaaccaaaggttgaaccggtttcagattcaggacaatcggtatataaccagatcatgagtagattacctcagatttga

SEQ ID NO: 66 - DNA, 1014 bp, Arabidopsis thaliana
atggagaaatcagatcctccaccagtcccaaagcccggcgccactattatcccctcctccgatccaattcctaatgccgatccgattccatcttcttccttccaccgccgatctcgctccgacgatatgtccatgttcatgttcatggatcccctctcctccgccgcaccaccttcctccgacgaccttccctccgacgacgatctcttctcttctttcatcgatgtcgatagcctcacctctaatcccaatccctttcaaaatccttccctctcctccaactccgtttccggcgctgctaatcctcctcctcctccttcctctcgtcctcgccaccgtcacagcaattccgttgacgctggatgcgccatgtatgccggtgatatcatggacgctaagaaagctatgcctcctgaaaaactctctgagctttggaacatcgatcccaaacgcgccaaaaggattctagcgaatcgacaatctgcagctcgatccaaagagagaaaagctcgatacattcaagaacttgagcgcaaagttcaatctcttcaaaccgaagctaccactctctctgctcagcttactctctaccagagagacacaaatggactagcaaacgaaaacacagagctgaaacttaggttgcaagcaatggaacaacaagctcagcttcgtaatgctttaaacgaagcgttgaggaaagaagttgaaaggatgaagatggagacaggagaaatctctggtaattcagattcgtttgatatgggaatgcagcagattcagtattcttcctcaactttcatggctattccaccatatcatggctcaatgaacctccatgatatgcagatgcattctagtttcaatcctatggagatgtccaattctcaaagcgtgtcggactttctacagaacggccgaatgcaagggctggagattagtagcaatagctcaagcttagtcaaatctgaaggaccttctctctctgctagtgagagtagctctgcctattga

SEQ ID NO: 67 - DNA, 948 bp, Arabidopsis thaliana
atgacgtcgtttcaggtgatgcgttcttcaaattcgagaaactcggatctatctcgtcgcatctcttctgcttctacttcttcttcgtctataagacctcaacaacagttccggcgagatctaacaagtgtcggttacggcggaagaaacgacggattatacagttcaaattcgatgacggtcgaagggattttacacgatactttcgcatcagatccaccagcaccaacggaatcttcactcttagatgcgtcgataaatctgatggatgcttctccagcaccaatggagataacaacaacgacggcttctgatgttgtggatcacggcggaggaacggagacgacgcgtggtgggaagagtgttgatgagatttggagagagatggtatcaggagaaggtaaagggatgaaggaagagacgtcggaagagataatgacgttagaggattttctagcgaaagctgcggtggaagacgaaacagcggtgacggcgtcggcggaggatttggatgtgaagattccggtgacgaattacggattcgatcattctgcaccgccgcataatccgtttcagatgattgataaagtagaaggatcaatagttgcgtttgggaatggtttagatgtttacggaggaggagctagagggaagagagcgagagtgatggttgagccattggataaagcagctgcacagagacagagaaggatgattaagaatcgtgaatctgcagctaggtctagagagaggaaacaagcttatcaagttgagttagaagctttggctgcgaagcttgaggaagagaatgagttgctttctaaggagattgaagataagaggaaagagagataccagaagttgatggagtttgtgattcctgttgttgagaaaccgaagcagcagccaccacggtttttacgcaggattcggtctttggaatggtga

SEQ ID NO: 68 - DNA, 3552 bp, Arabidopsis thaliana
atggggacagagctaatgagaatctgtgtgaaagaagatagtgatgatttgccatctgttcctcctggttttgaatcatatgcaacttttaccttaaaaagagtagtccctgctactacttctgataaagccaagactcctgcaattgaaagtgtttctgcaaccgaacaagctaagatggaagttgaatctgatgaagccaaagctgctcgggctctacgccgtagaccttggattaatcatagcggatgtgatgatgatggtgattgtgctgcaaacaatgacaatgctgcatctcaaaatcctgatcaaaattgtgatgtgaagccagctcttccaaagggtgtggtcaggggatgtgaagaatgtaaagattgtcagaaggagtttgaagacactttaaattatatcgctaaaataagaccggaggctgaaaagtatggaatctgtcgcattgttcctcctccttcctggaaaccgccgtgcccactgaaagaaaagcaagtatgggagggttctaaatttacaacacgtgtccaaagagttgataaacttcagaatcggagttcaatgaagaagatttcaaagcttcctaatcaaatgagaaagaagaaaagaaagtgcatgaaaatgggaatggattctgtcactaatggtatgggcgatccctgttctgcaagcactggaatgaatgaacttgagacgtttgggtttgaacctggtccagggttcacactaaaagacttccaaaaatatgctgatgagttcaaggctcagtactttaaaaagagtgaaacttctacagacgataaatgtaaagttgataattcaatagactgctgggagccagcacttgaggatgttgaaggtgaatattggcggatagtagataaagcaactgaagagatagaggtgctatatggtgctgaccttgaaactggggtatttggtagcggattccccaagatatcatcaagtcacaatgcttcttcttcagaagataaatatgcaaaatcaggctggaacttaaataactttccaaggcttccgggatccctccttaagtacgagggcagtgatatttccggtgtccttgtgccgtggctgtatattgggatgtgcttttcttctttctgctggcatgttgaagatcaccacttgtattcgttgaattatatgcactggggtgcaccgaaattgtggtatggtgttggggggaaggatgctgttaaactcgaggaggcaatgaggaagcatttgcctgacctttttgaagaacagcctgacttacttcataagctagttacacaactctccccgtcaaaactgaaaaccgcaggagtacctgtgcaccgttgcgtccagcatgctggagagtttgtcttgacttttcctcgggcatatcatgctggatttaattctggtttcaactgtgctgaagctgtgaatgtagcacccgttgactggttacctcatgggcagattgccatagagttatactgtcaacagggtagaaaaacgtccatctcgcatgataaattgttgcttggggcagcaagggaagtagtgaaagccgactgggagctgaacttactaaggaaaaatactgtagataacttaaggtggaaagcattcagtgcgaaggatggaattttggcaaaaacattaaaggcacgcattgacatggaacgtacgagaagagaatttctgtgcaactcttcacttgcattgaaaatgcacagtaatttcgatgctaccaacgagagagagtgctgtatatgcttctttgatttgcacctgtctgctgctggctgtcgttgttccccggagaagtattcatgtttgactcatgtgaaggagttgtgttcatgtccatgggttactaaatattttctatttcgctatgatatcgatgaactgaatgttcttgttgaggcagtggaaggaaaactgagttctgtatatagatgggcgcgtcaagatttaggattggcattaagtacagacgtctcaggaagcaagatggagatagatgaagaaggaaaagtccacaaggacccgactccacaaacaactgcactttcagggaaggatttgcagttgaaagtaacatcgaaagaagtaagtaaagagttagaaaagactagtaaattatctcatgttaatttacttctgaaagaaaaggaggagcaaataacgtcaagtcactgtatgaagcctgtcaaagaagaaactgtttgtgattcttctgatccaaacgtttcagcttgccaaccatctgaaggaggcataatctgtatgacagctgttaagtccgcaagtggtaaaaagaattcacagagtctacccaatgatgtgatactcctcagcgatgatgagtatgacatacctaggaaacgaggttctgtgagaagagatgcaatttcttctggcaagaaattagaaatacgagagagaccgacccacgttttggcgttagaagcttctgccaaaattgctgctccaatttgccaaagggaaggagattcgctgcgtgatacacgaaacactatatcattgcctactaatgaccaaaaaacaatgagaagggatgtaccgagttctacttcgcacgcggaagttaatgcggaggctactgggcttactcaagatatatgtaacagaatggcaactaacagccacggtggtggaaaacctactagttgtaaatccaaaaactctggaggtttggctatagtggatgttgtggatgggacaagaagtagttcaggtacaccgtcttgttcgcaaaataatagtccggataggttcatccgccaaaagggtccccgcattgcaaaggtcgtgaggagaatcaattgcaatgtagagcctttaagttatggatgtgtgctgtctggaaaatcatggtgcagccggcgagcaatttttcctaaaggatttcgtagccgggttaagtacataaacattttggatccaacaaatatgtgcttctacatttcagaaattctggatgctggacgcaacagtccattgttcatggtttacttggagagtaatcccagtgaggtgttcgttcatatgtcgcctacaagatgctgggagatggtaagagagagagtaaatcaagagataactaagcagcacaaagctggaaaatcagatcttcctcctttgcaaccctctgggagtcccgacggttttgaaatgtttggatattcgtcacccgcaatcgtacaggctatcgaagcattagacgtgaatcgagtttgcacagactattgggattccaggccttattcccggccacaagttcagttccctgcaaatcctcttctcagagaagccaacacaagtggcagatcgaatgtgggaaatctccagctaaaccctggacaccatatatcgcctactggaataaattctattcttaaagttctgttcaagaaagctagcatggaggaactaagctcacttcaagaggttttaagtgagactaactcagatatggtgaccgaacttgtgaaggaagagatccagaaccgtcgctga

SEQ ID NO: 69 - DNA, 2652 bp, Arabidopsis thaliana
atggattctggagttaaattggagcatatgaattgtttccaattatcttatcaatattcgtggacgactaggaagaagagaactctgaaaccattcatgtcaaaaggttctagccctagtagtagtagtgatagtaggaaacggaagctttcgagagctgaagatagcgatgattcagcggttaaacggaatgcgaaacgaaggagaaagatatgcaaagtagaagaatattatgaagatgatgattgcatattaagtgattgggttcagaggaatactgcgaaaaggattgataagcgcaacgaagaagttgaagttatggttaagatagagtcaggtgatgattgcacaataggtaagtggttttctgatgttagtagtaaaaggaaagataaacgacaagtagaagttgatgaagatgaggaatgggaagaagaagttacactgtgttctaagatcaaggcaacgtcgtcgcgaagcagaacccatagtttaagtgctaacagtccagaaaatgttacagatgttattagtccttgtcgttcacggtctccagcttctaatgtatcagattccattcagaaaaatgactgcaccagtagtagaaaacagagtggcccaatttgtcatcagtgcttgaaaggggaaaggataacacttctcatttgtagtgaatgtgagaagacaatgttttgtcttcaatgtataaggaaatggtatccaaatctatctgaggatgatgttgttgagaaatgtcctttatgccgtcaaaattgtaattgtagcaaatgcttgcatttgaatggtttaattgagacatcgaagagggaactcgcgaaatctgaaagacgtcatcatctccagtatttgattacgttgatgcttccttttctgaataagttatccatattccagaagctagagattgaatttgaggcaactgttcaaggaaaactgccttctgaagttgaaataactgcggctataagctacactgatgaacgtgtatactgtgatcattgtgcaacttcaattgttgacttgcatcgaagctgtccaaagtgctcttatgaactttgtttgaagtgctgtcaagagattcgtgaaggatcgctttctgaacgccctgaaatgaagttccattatgttgatagaggacatcgatatatgcatggtttagatgctgcggaaccgagcttgtcttccacttttgaagacgaagaagctaacccatctgacgctaagtggagccttggtgaaaatggaagcatcacttgtgcaccagaaaagctaggtggttgtggtgaacggatgctagagcttaggcggatcctaccactcacgtggatgtcagatttagagcacaaagcagagactttcttatcatcatacaatataagccctagaatgttgaactgtaggtgttcttctttggagacagagctgacaaggaaatcagcttcgaggacaacatcaagtgacaactaccttttctgtcctgaatctctcggtgtcttgaaggaagaagagcttcttcattttcaagagcattgggcaaaaggcgaaccagtaatcgttaggaacgctcttgacaacacacctggtttaagctgggagccgatggttatgtggcgggctttatgcgaaaatgtgaattcaacatcaagctctgagatgtcccaagtcaaagcaattgattgcttagctaattgtgaggtggagatcaatactcgtcagttctttgaaggttatagcaaaggaagaacatatgaaaatttctggcctgagatgttgaagcttaaggactggcctccttctgataagtttgaagatcttctacctcgtcactgtgatgagttcatatccgcgttacctttccaggaatatagtgatcctagaactggaattcttaacattgcaacaaagcttcctgaaggatttatcaaaccagatttaggtccaaaaacttacatcgcctatgggattccagatgagcttggtagaggcgattccgtgactaagcttcactgcgatatgtcagacgcggtgaatattctaacgcatacggccgaagtgaccctaagtcaagaacaaatatcctcagtcaaagcactgaaacagaaacacaagttacagaataaggtcgataaacagagtactgaagactgtaacgaaaaggaagaagaagaagaagaagaattgaacatgccagagatttcgagcaatgaaaatgaagaaacgggcagtgctctttgggacatatttaggagagaagacgttcccaagttagaagagtatctaagaaagcattgcaaagaatttagacacacttattgtagtccagttacaaaggtttatcatccgatacatgaccaatcatgctatttaaccttagagcacaaaagaaaactcaaggcggaatatgggatcgagccatggacatttgtgcaaaagctaggtgaagcggtgtttattcccgcgggttgtcctcatcaagttcggaatctaaagtcgtgcacaaaagtcgcagttgactttgtgtcaccagagaacatccatgagtgtctgcgtttgaccgaagagtttcgccaacttcccaaaaaccacaaggccagagaggacaaactcgaggcaagtcttttatctctttga

SEQ ID NO: 70 - DNA, 2187 bp, Arabidopsis thaliana
atgtcggagaacgaaatcgtccctgacgagtttcgttgcaaccgctctgatggtaagcaatggcggtgcaagagacgagctttagaggggaaaaagatgtgtgagagtcatcactcgcagcaaagcctaaagcgaagtaagcagaaagttgcagagtcttctaagcttgtcagatcaagaagaggaggaggagatgaagtggcgtcttcagagatcgagccaaacgaaagcagaattaggtctaagagattggggaaatcgaagaggaagagagtgatgggtgaagcagaggctatggatgaagcagtgaagaagatgaagttgaagagaggagatttgcagttggatttgataaggatggtgttgaagagagaagttgagaagaggaagagattaccaaatagtaataataagaagaagagtaatggagggtttagtgaatttgttggagaagagttaacgagggttcttcctaatggtattatggcaatttctccaccttctcctactactagtaatgtgtcttctccttgtgatgttaaagttggggaagagccaatttcgatgattaaaaggaggtttaggtctaagaacattgaacctttgccaattgggaaaatgcaggattctcagagtgtcaggagtgatattgacagggttttgcatctacattatgcggtgtgcatgctacttccagtactaaaagaaatcaatgcggaacacaaagtggaggtggaaaatgacgcagaaaagaaagtggatttgcaaagaatgtgcacacgcagttcctctgttctcaggctaaattctgaccaagatcagagtcaagagagcttatctagaaaggttggatcggttaaatgctcgaatggtataaaatctccaaaagtgttgctggattttcatcaaaacaatctggaacattttcagacacactggagtaaaggccatcctgtaatagttcgtagtgtgataaagagtggttcaagcctgaattgggatccagtagccttgttctgtcactatcttatgaacagaaacaacaaaaccggtaatactactgattgtatggattggtttgaggtagaaattggtgtcaagcaattttttttggggtctttgagaggaaaggctgagactaatacttgtcaagaaaggctgaagctggagggatggctttcatcttcattgtttaaagaacagttcccaaatcattacgctgaaatactgaatattttaccaatctcccattacatggatccaaagcgcggtctactaaatattgcagccaacctacctgacactgtacaaccacccgattttggcccatgcctcaatatttcatacaggagtggtgaagaatatgcacagcctgattctgtgaagaagttaggttttgaaacttgtgacatggttgatatcttgttatatgtcacagaaacacctgtatccacaaaccagatttgtaggataagaaagctaatgaaaaacatcggaagagtaagatctaaaaatccggcaaaggggagggaaagcagatttgataagggaaagaaacgagataggttggatgactattccagttctgattcagaatcttcacaacactgtttaggcgctaaatgcagaggcagtgagtttgagggagaggaaagagaaagttgcaactactcttgtgaagaagagagcctaagcaacacttatggtgcccagtgggatgtattccaaaaacaagatgtttctaaacttcttgagtatattaagaaccactctctggagctagaatccatggattccagcaaaaaaaaggtgagtcatccattacttgagcagagttactatcttgatgagtatcacaaagcaaggcttaaggaagaatttgacgttgaaccatggagttttgatcaatgtgttggggaagcagtcatcctccctgctggatgtccataccaaattagaaagaataagtcttgtgtaaatgcggttctgaagtttctgtcacctgagcacgttagcgaatctattaaacgagtgaaggagctcaatcaacttcctcagagcgtcaaatcgaaagcaaataagattgaggtgaagaaaatggcgattcataaaatcagcgaagctgtaaaggaaattcgggaactcacatcttcggattcaactggtgcattgagattatataactag

SEQ ID NO: 71 - DNA, 870 bp, Arabidopsis thaliana
atgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactag

SEQ ID NO: 72 - DNA, 651 bp, Arabidopsis thaliana
atgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaa

SEQ ID NO: 73 - DNA, 855 bp, Arabidopsis thaliana
atgggtcaagatgaggttgggagtgatcagacgcaaatcataaaagggaaacgtacgaagcgacaaagatcgtcttcgacgtttgtggtgacggcggcgacaacagtgacttcaacaagttcatcggccggtggaagtggaggagaaagagctgtttcagatgaatacaactcggcggtttcgtctccggtgactactgattgtacgcaagaagaagaagacatggcgatttgtctcatcatgttagctcgtgggacagttcttccatcgccggatctcaagaactcgagaaaaattcatcagaagatttcgtcggagaattctagtttctatgtgtacgagtgtaaaacgtgtaaccggacgttttcgtcgttccaagcacttggtggacacagagcgagccacaagaagccgaggacgtcgactgaggaaaagactagactacccctgacgcaacccaagtctagtgcatcagaagaagggcaaaacagtcatttcaaagtttccggctcagccctagcttcacaggcaagtaacatcatcaacaaggcaaacaaagtacacgagtgttccatctgcggttctgagttcacttccgggcaagctctcggtggtcacatgaggcggcacaggacagccgtaaccacgattagccccgttgcagccaccgcagaagtaagcagaaacagtacagaggaagagattgagatcaatataggccgttcgatggaacagcagaggaaatatctaccgttggatcttaatctaccagcaccagaagatgatctaagagagtcaaagtttcaagggatagtattctcagcaacaccagcgttaatagattgtcattactag

SEQ ID NO: 74 - DNA, 741 bp, Arabidopsis thaliana
atggctccagtcggattacctccaggctttagatttcatccgactgacgaagaactcgtaaactattatctgaaaagaaagatcaacggtcaagaaatcgagcttgatataattcccgaggttgatctctacaaatgcgagccatgggacctcgcagagaagtcgtttctaccaagtagagatccggagtggtatttttttgggccacgtgaccggaagtatccgaacgggtttaggacgaaccgagcaacgagaggtgggtactggaaatcgaccggcaaagatcggagagtgacaagtcaaagcagagcgattgggatgaaaaagactttggtttattataaaggaagagctcctcaagggatccgtacggattgggttatgcatgagtatcgtctcgatgataaggattgtgacgatccctcttcgctccaggactcgtatgcattgtgtcgggtattcaaaaagaacggaatatgttcggagttggaatcagaacggcaattgcaaacgggacaatgtagcttcacaacggcgtcaatggaggagatcaattcgaataacaacaacaattataataatgattatgagacaatgtcgccggaggtgggagtttcctccgcctgcgttgaagaagtagtcgatgataaagacgattcgtggatgcagtttataacagatgacgcatgggacacgtcatcaaatggtgcagctatgggacatggtcaaggggtttattga

SEQ ID NO: 75 - DNA, 438 bp, Arabidopsis thaliana
atggagggatatgataatgggtcgttgtatgctccttttttgtcgttgaaatctcattcgaaaccagagctgcatcaaggcgaagaagagagctcaaaggttagatcagaaggttgttcgaaaagcgtggagtcgtcgaaaaagaaggggaagaaacaaaggtatgcgtttcaaacaaggagccaagtggatattcttgatgatggttatcgatggaggaaatatggccaaaaggccgtcaagaacaacaagttccctaggagttactataggtgtacatatggaggatgcaatgtgaagaagcaagtgcaaagattaacagtggaccaagaagtggtcgtgacaacctacgaaggagtgcattcgcatcccatcgagaaatccaccgaaaacttcgagcatattctcactcaaatgcaaatctactcttctttctag

SEQ ID NO: 76 - protein, 645 aa, Arabidopsis thaliana
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQNLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 77 - protein, 574 aa, Arabidopsis thaliana
MDSGDATSLLLTKIRSLEPDYAPKIIGNSPSSPSSTSPWSFNNCINGNNGNNPHISPKHTPISKPFSSHQSNGLSATHSGSADAAGGADLLDDQQLNDCLSFLDDSCSKTEDLVDPSIPLDYSVDGDGETHLHRRSFSCDASFVSGDDGFGGGCKPCVYFSRGLCKNGESCKFIHGGYPDNMDGNGIVADSPRKMENFVRQHEEMMRLKLAYQQQRLASQILGRAPQLPYEKRMDFLLQQHAQRDGGLPFGDERFWSSSPGRLERMELAMHLGDQSNSASRQIYLTFPADSTFKDEDVATYFSLFGTVQDVRIPYQQKRMFGFVSFAHPETVKVVLARGNPHFICDSRVLVKPYKEKGKVLDKKQQQLLQQQIERGNYSPCSSPSGIDPREQSDFHLGSKMLYERREMMRRKIEQADLLRAIELERRRFINLQLPEFKNSVTLNHHRSFSVGSPGYFSSAGNQSPDFQSELNGADALKVTDDTLELHPYPVVNPMSVNNSYSNGAKEETNKSELLDPDSGSTIELVLPSNLFPSASSTDDHKTDDSAETNAKVGVSSTNENDHEPPVTTNNLMQ

SEQ ID NO: 78 - protein, 535 aa, Arabidopsis thaliana
MVITANDLSKWENFPKGLKVLLLLNGCDSDGDGSSAAETRSELESMDYIVTTFTDETEALSAVVKNPESFHIAIVEVNMSAESESFKFLEAAKDVLPTIMISTDHCITTTMKCIALGAVEFLQKPLSPEKLKNIWQHVVHKAFNDGGSNVSISLKPVKESVVSMLHLETDMTIEEKDPAPSTPQLKQDSRLLDGDCQENINFSMENVNSSTEKDNMEDHQDIGESKSVDTTNRKLDDDKVVVKEERGDSEKEEEGETGDLISEKTDSVDIHKKEDETKPINKSSGIKNVSGNKTSRKKVDWTPELHKKFVQAVEQLGVDQAIPSRILELMKVGTLTRHNVASHLQKFRQHRKNILPKDDHNHRWIQSRENHRPNQRNYNVFQQQHRPVMAYPVWGLPGVYPPGAIPPLWPPPLQSIGQPPPWHWKPPYPTVSGNAWGCPVGPPVTGSYITPSNTTAGGFQYPNGAETGFKIMPASQPDEEMLDQVVKEAISKPWLPLPLGLKPPSAESVLAELTRQGISAVPSSSCLINGSHRLR

SEQ ID NO: 79 - protein, 877 aa, Arabidopsis thaliana
MVPSEPPNPVGGGENVPPSILGGQGGAPLPSQPAFPSLVSPRTQFGNNMSMSMLGNAPNISSLLNNQSFVNGIPGSMISMDTSGAESDPMSNVGFSGLSSFNASSMVSPRSSGQVQGQQFSNVSANQLLAEQQRNKKMETQSFQHGQQQSMQQQFSTVRGGGLAGVGPVKMEPGQVSNDQQHGQVQQQQQKMLRNLGSVKLEPQQIQAMRNLAQVKMEPQHSEQSLFLQQQQRQQQQQQQQQFLQMPGQSPQAQMNIFQQQRLMQLQQQQLLKSMPQQRPQLPQQFQQQNLPLRPPLKPVYEPGMGAQRLTQYMYRQQHRPEDNNIEFWRKFVAEYFAPNAKKRWCVSMYGSGRQTTGVFPQDVWHCEICNRKPGRGFEATAEVLPRLFKIKYESGTLEELLYVDMPRESQNSSGQIVLEYAKATQESVFEHLRVVRDGQLRIVFSPDLKIFSWEFCARRHEELIPRRLLIPQVSQLGSAAQKYQQAAQNATTDSALPELQNNCNMFVASARQLAKALEVPLVNDLGYTKRYVRCLQISEVVNSMKDLIDYSRETRTGPIESLAKFPRRTGPSSALPGPSPQQASDQLRQQQQQQQQQQQQQQQQQQQQQQQQTVSQNTNSDQSSRQVALMQGNPSNGVNYAFNAASASTSTSSIAGLIHQNSMKGRHQNAAYNPPNSPYGGNSVQMQSPSSSGTMVPSSSQQQHNLPTFQSPTSSSNNNNPSQNGIPSVNHMGSTNSPAMQQAGEVDGNESSSVQKILNEILMNNQAHNNSSGGSMVGHGSFGNDGKGQANVNSSGVLLMNGQVNNNNNTNIGGAGGFGGGIGQSMAANGINNINGNNSLMNGRVGMMVRDPNGQQDLGNQLLGAVNGFNNFDWNA

SEQ ID NO: 80 - protein, 359 aa, Arabidopsis thaliana
MMIGESHRGFNPTVHIPPWPLSEDLTVSDIYGSPDGGSSMMEALAELQRYLPSNEPDPDSDPDLSGPDSPIDAYTCDHFRMYEFKVRRCARGRSHDWTECPYAHPGEKARRRDPRKFHYSGTACPEFRKGCCKRGDACEFSHGVFECWLHPARYRTQPCKDGGNCRRRVCFFAHSPDQIRVLPNQSPDRVDSFDVLSPTIRRAFQFSISPSSNSPPVSPRGDSDSSCSLLSRSLGSNLGNDVVASLRNLQLNKVKSSLSSSYNNQIGGYGSGFGSPRGSVLGPGFRSLPTTPTRPGFMNIWENGLEEEPAMERVESGRELRAQLFEKLSKENCMGRIEPDPDQGAGDTPDVGWVSDLVM

SEQ ID NO: 81 - protein, 262 aa, Arabidopsis thaliana
MCGGAVISDYIAPEKIARSSGKSSWRSNGVFDCSIYDFDGNFDELESDEPFVFSSTHKHHASGSASDGKKKQSSRYKGIRRRPWGRWAAEIRDPIKGVRVWLGTFNTAEEAARAYDLEAKRIRGAKAKLNFPNESSGKRKAKAKTVQQVEENHEADLDVAVVSSAPSSSCLDFLWEENNPDTLLIDTQWLEDIIMGDANKKHEPNDSEEANNVDASLLSEELLAFENQTEYFSQMPFTEGNCDSSTSLSSLFDGGNDMGLWS

SEQ ID NO: 82 - protein, 637 aa, Arabidopsis thaliana
MTTEQALLSMEALPLGFRFRPTDEELINHYLRLKINGRDLEVRVIPEIDVCKWEPWDLPGLSVIKTDDQEWFFFCPRDRKYPSGHRSNRATDIGYWKATGKDRTIKSKKMIIGMKKTLVFYRGRAPRGERTNWIMHEYRATDKELDGTGPGQNPYVLCRLFHKPSDSCDPAHCEEIEKVNFTPTTTTRCSPDDTSSEMVQETATSGVHALDRSDDTERCLSDKGNNDVKPDVSVINNTSVNHAETSRAKDRNLGKTLVEENPLLRDVPTLHGPILSEKSYYPGQSSIGFATSHMDSMYSSDFGNCDYGLHFQDGASEQDASLTDVLDEVFHNHNESSNDRKDFVLPNMMHWPGNTRLLSTEYPFLKDSVAFVDGSAEVSGSQQFVPDILASRWVSEQNVDSKEAVEILSSTGSSRTLTPLHNNVFGQYASSSYAAIDPFNYNVNQPEQSSFEQSHVDRNISPSNIFEFKARSRENQRDLDSVVDQGTAPRRIRLQIEQPLTPVTNKKERDADNYEEEDEVQSAMSKVVEEEPANLSAQGTAQRRIRLQTRLRKPLITLNNTKRNSNGREGEASHRKEKEDISSSSSWQKQKKSLVQFSSVVIIVAVIVVLVEIWKESRDAKCSFLFHQLDSFKGMFT

SEQ ID NO: 83 - protein, 454 aa, Arabidopsis thaliana
MGSRLNFKSFVDGVSEQQPTVGTSLPLTRQNSVFSLTFDEFQNSWGGGIGKDFGSMNMDELLKNIWTAEESHSMMGNNTSYTNISNGNSGNTVINGGGNNIGGLAVGVGGESGGFFTGGSLQRQGSLTLPRTISQKRVDDVWKELMKEDDIGNGVVNGGTSGIPQRQQTLGEMTLEEFLVRAGVVREEPQPVESVTNFNGGFYGFGSNGGLGTASNGFVANQPQDLSGNGVAVRQDLLTAQTQPLQMQQPQMVQQPQMVQQPQQLIQTQERPFPKQTTIAFSNTVDVVNRSQPATQCQEVKPSILGIHNHPMNNNLLQAVDFKTGVTVAAVSPGSQMSPDLTPKSALDASLSPVPYMFGRVRKTGAVLEKVIERRQKRMIKNRESAARSRARKQAYTMELEAEIAQLKELNEELQKKQVEIMEKQKNQLLEPLRQPWGMGCKRQCLRRTLTGPW

SEQ ID NO: 84 - protein, 597 aa, Arabidopsis thaliana
MCGAKSNLCSSKTLTEVEFMRQKSEDGASATCLLEFAACDDLSSFKREIEENPSVEIDESGFWYCRRVGSKKMGFEERTPLMVAAMYGSMEVLNYIIATGRSDVNRVCSDEKVTALHCAVSGCSVSIVEIIKILLDASASPNCVDANGNKPVDLLAKDSRFVPNQSRKAVEVLLTGIHGSVMEEEEEELKSVVTKYPADASLPDINEGVYGTDDFRMFSFKVKPCSRAYSHDWTECPFVHPGENARRRDPRKYPYTCVPCPEFRKGSCPKGDSCEYAHGVFESWLHPAQYRTRLCKDETGCARRVCFFAHRRDELRPVNASTGSAMVSPRSSNQSPEMSVMSPLTLGSSPMNSPMANGVPLSPRNGGLWQNRVNSLTPPPLQLNGSRLKSTLSARDMDMEMELRFRGLDNRRLGDLKPSNLEETFGSYDSASVMQLQSPSRHSQMNHYPSSPVRQPPPHGFESSAAMAAAVMNARSSAFAKRSLSFKPAPVASNVSDWGSPNGKLEWGMQRDELNKLRRSASFGIHGNNNNSVSRPARDYSDEPDVSWVNSLVKENAPERVNERVGNTVNGAASRDKFKLPSWAEQMYIDHEQQIVA

SEQ ID NO: 85 - protein, 222 aa, Arabidopsis thaliana
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQLLDLDLNLPPPSEQA

SEQ ID NO: 86 - protein, 638 aa, Arabidopsis thaliana
MANRGGEYLYDELWKLCAGPLVDVPQAQERVYYFPQGHMEQLEASTQQVDLNTMKPLFVLPPKILCNVMNVSLQAEKDTDEVYAQITLIPVGTEVDEPMSPDPSPPELQRPKVHSFSKVLTASDTSTHGGFSVLRKHATECLPPLDMTQQTPTQELVAEDVHGYQWKFKHIFRGQPRRHLLTTGWSTFVTSKRLVAGDTFVFLRGENGELRVGVRRANLQQSSMPSSVISSHSMHLGVLATARHATQTKTMFIVYYKPRTSQFIISLNKYLEAMSNKFSVGMRFKMRFEGEDSPERRYSGTVIGVKDCSPHWKDSKWRCLEVHWDEPASISRPNKVSPWEIEPFVNSENVPKSVMLKNKRPRQVSEVSALDVGITASNLWSSVLTQPHEFAQSCITSQWSSPQQCHRDANEDAKKSDWLNNSYSVSNVAKDSTLNDQMVSPVEQKKPETTANYRLFGIDLMSSSLAVPEEKTAPMRPINISKPTMDSHSDPKSEISKVSEEKKQEPAEGSPKEVQSKQSSSTRSRTKVQMQGVPVGRAVDLNALKGYNELIDDIEKLFDIKGELRSRNQWEIVFTDDEGDMMLVGDDPWPEFCNMVKRIFIWSKEEVKKMTPGNQLRMLLREVETTLTTTSKTDNHSN

SEQ ID NO: 87 - protein, 243 aa, Arabidopsis thaliana
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAVGLAPRAMEKYCKNRS

SEQ ID NO: 88 - protein, 620 aa, Arabidopsis thaliana
MALSLLRKNKHGFDIVISDVHMPDMDGFKLLEHVGLEMDLPVIMMSADDSKSVVLKGVTHGAVDYLIKPVRMEALKNIWQHVVRKRRSEWSVPEHSGSIEETGERQQQQHRGGGGGAAVSGGEDAVDDNSSSVNEGNNWRSSSRKRKDEEGEEQGDDKDEDASNLKKPRVVWSVELHQQFVAAVNQLGVEKAVPKKILELMNVPGLTRENVASHLQKYRIYLRRLGGVSQHQGNLNNSFMTGQDASFGPLSTLNGFDLQALAVTGQLPAQSLAQLQAAGLGRPAMVSKSGLPVSSIVDERSIFSFDNTKTRFGEGLGHHGQQPQQQPQMNLLHGVPTGLQQQLPMGNRMSIQQQIAAVRAGNSVQNNGMLMPLAGQQSLPRGPPPMLTSSQSSIRQPMLSNRISERSGFSGRNNIPESSRVLPTSYTNLTTQHSSSSMPYNNFQPELPVNSFPLASAPGISVPVRKATSYQEEVNSSEAGFTTPSYDMFTTRQNDWDLRNIGIAFDSHQDSESAAFSASEAYSSSSMSRHNTTVAATEHGRNHQQPPSGMVQHHQVYADGNGGSVRVKSERVATDTATMAFHEQYSNQEDLMSALLKQEGIAPVDGEFDFDAYSIDNIPV

SEQ ID NO: 89 - protein, 345 aa, Arabidopsis thaliana
MEELKVEMEEETVTFTGSVAASSSVGSSSSPRPMEGLNETGPPPFLTKTYEMVEDPATDTVVSWSNGRNSFVVWDSHKFSTTLLPRYFKHSNFSSFIRQLNTYGFRKIDPDRWEFANEGFLAGQKHLLKNIKRRRNMGLQNVNQQGSGMSCVEVGQYGFDGEVERLKRDHGVLVAEVVRLRQQQHSSKSQVAAMEQRLLVTEKRQQQMMTFLAKALNNPNFVQQFAVMSKEKKSLFGLDVGRKRRLTSTPSLGTMEENLLHDQEFDRMKDDMEMLFAAAIDDEANNSMPTKEEQCLEAMNVMMRDGNLEAALDVKVEDLVGSPLDWDSQDLHDMVDQMGFLGSEP

SEQ ID NO: 90 - protein, 687 aa, Arabidopsis thaliana
MAGFDENVAVMGEWVPRSPSPGTLFSSAIGEEKSSKRVLERELSLNHGQVIGLEEDTSSNHNKDSSQSNVFRGGLSERIAARAGFNAPRLNTENIRTNTDFSIDSNLRSPCLTISSPGLSPATLLESPVFLSNPLAQPSPTTGKFPFLPGVNGNALSSEKAKDEFFDDIGASFSFHPVSRSSSSFFQGTTEMMSVDYGNYNNRSSSHQSAEEVKPGSENIESSNLYGIETDNQNGQNKTSDVTTNTSLETVDHQEEEEEQRRGDSMAGGAPAEDGYNWRKYGQKLVKGSEYPRSYYKCTNPNCQVKKKVERSREGHITEIIYKGAHNHLKPPPNRRSGMQVDGTEQVEQQQQQRDSAATWVSCNNTQQQGGSNENNVEEGSTRFEYGNQSGSIQAQTGGQYESGDPVVVVDASSTFSNDEDEDDRGTHGSVSLGYDGGGGGGGGEGDESESKRRKLEAFAAEMSGSTRAIREPRVVVQTTSDVDILDDGYRWRKYGQKVVKGNPNPRSYYKCTAPGCTVRKHVERASHDLKSVITTYEGKHNHDVPAARNSSHGGGGDSGNGNSGGSAAVSHHYHNGHHSEPPRGRFDRQVTTNNQSPFSRPFSFQPHLGPPSGFSFGLGQTGLVNLSMPGLAYGQGKMPGLPHPYMTQPVGMSEAMMQRGMEPKVEPVSDSGQSVYNQIMSRLPQI

SEQ ID NO: 91 - protein, 337 aa, Arabidopsis thaliana
MEKSDPPPVPKPGATIIPSSDPIPNADPIPSSSFHRRSRSDDMSMFMFMDPLSSAAPPSSDDLPSDDDLFSSFIDVDSLTSNPNPFQNPSLSSNSVSGAANPPPPPSSRPRHRHSNSVDAGCAMYAGDIMDAKKAMPPEKLSELWNIDPKRAKRILANRQSAARSKERKARYIQELERKVQSLQTEATTLSAQLTLYQRDTNGLANENTELKLRLQAMEQQAQLRNALNEALRKEVERMKMETGEISGNSDSFDMGMQQIQYSSSTFMAIPPYHGSMNLHDMQMHSSFNPMEMSNSQSVSDFLQNGRMQGLEISSNSSSLVKSEGPSLSASESSSAY

SEQ ID NO: 92 - protein, 315 aa, Arabidopsis thaliana
MTSFQVMRSSNSRNSDLSRRISSASTSSSSIRPQQQFRRDLTSVGYGGRNDGLYSSNSMTVEGILHDTFASDPPAPTESSLLDASINLMDASPAPMEITTTTASDVVDHGGGTETTRGGKSVDEIWREMVSGEGKGMKEETSEEIMTLEDFLAKAAVEDETAVTASAEDLDVKIPVTNYGFDHSAPPHNPFQMIDKVEGSIVAFGNGLDVYGGGARGKRARVMVEPLDKAAAQRQRRMIKNRESAARSRERKQAYQVELEALAAKLEEENELLSKEIEDKRKERYQKLMEFVIPVVEKPKQQPPRFLRRIRSLEW

SEQ ID NO: 93 - protein, 1183 aa, Arabidopsis thaliana
MGTELMRICVKEDSDDLPSVPPGFESYATFTLKRVVPATTSDKAKTPAIESVSATEQAKMEVESDEAKAARALRRRPWINHSGCDDDGDCAANNDNAASQNPDQNCDVKPALPKGVVRGCEECKDCQKEFEDTLNYIAKIRPEAEKYGICRIVPPPSWKPPCPLKEKQVWEGSKFTTRVQRVDKLQNRSSMKKISKLPNQMRKKKRKCMKMGMDSVTNGMGDPCSASTGMNELETFGFEPGPGFTLKDFQKYADEFKAQYFKKSETSTDDKCKVDNSIDCWEPALEDVEGEYWRIVDKATEEIEVLYGADLETGVFGSGFPKISSSHNASSSEDKYAKSGWNLNNFPRLPGSLLKYEGSDISGVLVPWLYIGMCFSSFCWHVEDHHLYSLNYMHWGAPKLWYGVGGKDAVKLEEAMRKHLPDLFEEQPDLLHKLVTQLSPSKLKTAGVPVHRCVQHAGEFVLTFPRAYHAGFNSGFNCAEAVNVAPVDWLPHGQIAIELYCQQGRKTSISHDKLLLGAAREVVKADWELNLLRKNTVDNLRWKAFSAKDGILAKTLKARIDMERTRREFLCNSSLALKMHSNFDATNERECCICFFDLHLSAAGCRCSPEKYSCLTHVKELCSCPWVTKYFLFRYDIDELNVLVEAVEGKLSSVYRWARQDLGLALSTDVSGSKMEIDEEGKVHKDPTPQTTALSGKDLQLKVTSKEVSKELEKTSKLSHVNLLLKEKEEQITSSHCMKPVKEETVCDSSDPNVSACQPSEGGIICMTAVKSASGKKNSQSLPNDVILLSDDEYDIPRKRGSVRRDAISSGKKLEIRERPTHVLALEASAKIAAPICQREGDSLRDTRNTISLPTNDQKTMRRDVPSSTSHAEVNAEATGLTQDICNRMATNSHGGGKPTSCKSKNSGGLAIVDVVDGTRSSSGTPSCSQNNSPDRFIRQKGPRIAKVVRRINCNVEPLSYGCVLSGKSWCSRRAIFPKGFRSRVKYINILDPTNMCFYISEILDAGRNSPLFMVYLESNPSEVFVHMSPTRCWEMVRERVNQEITKQHKAGKSDLPPLQPSGSPDGFEMFGYSSPAIVQAIEALDVNRVCTDYWDSRPYSRPQVQFPANPLLREANTSGRSNVGNLQLNPGHHISPTGINSILKVLFKKASMEELSSLQEVLSETNSDMVTELVKEEIQNRR

SEQ ID NO: 94 - protein, 883 aa, Arabidopsis thaliana
MDSGVKLEHMNCFQLSYQYSWTTRKKRTLKPFMSKGSSPSSSSDSRKRKLSRAEDSDDSAVKRNAKRRRKICKVEEYYEDDDCILSDWVQRNTAKRIDKRNEEVEVMVKIESGDDCTIGKWFSDVSSKRKDKRQVEVDEDEEWEEEVTLCSKIKATSSRSRTHSLSANSPENVTDVISPCRSRSPASNVSDSIQKNDCTSSRKQSGPICHQCLKGERITLLICSECEKTMFCLQCIRKWYPNLSEDDVVEKCPLCRQNCNCSKCLHLNGLIETSKRELAKSERRHHLQYLITLMLPFLNKLSIFQKLEIEFEATVQGKLPSEVEITAAISYTDERVYCDHCATSIVDLHRSCPKCSYELCLKCCQEIREGSLSERPEMKFHYVDRGHRYMHGLDAAEPSLSSTFEDEEANPSDAKWSLGENGSITCAPEKLGGCGERMLELRRILPLTWMSDLEHKAETFLSSYNISPRMLNCRCSSLETELTRKSASRTTSSDNYLFCPESLGVLKEEELLHFQEHWAKGEPVIVRNALDNTPGLSWEPMVMWRALCENVNSTSSSEMSQVKAIDCLANCEVEINTRQFFEGYSKGRTYENFWPEMLKLKDWPPSDKFEDLLPRHCDEFISALPFQEYSDPRTGILNIATKLPEGFIKPDLGPKTYIAYGIPDELGRGDSVTKLHCDMSDAVNILTHTAEVTLSQEQISSVKALKQKHKLQNKVDKQSTEDCNEKEEEEEEELNMPEISSNENEETGSALWDIFRREDVPKLEEYLRKHCKEFRHTYCSPVTKVYHPIHDQSCYLTLEHKRKLKAEYGIEPWTFVQKLGEAVFIPAGCPHQVRNLKSCTKVAVDFVSPENIHECLRLTEEFRQLPKNHKAREDKLEASLLSL

SEQ ID NO: 95 - protein, 728 aa, Arabidopsis thaliana
MSENEIVPDEFRCNRSDGKQWRCKRRALEGKKMCESHHSQQSLKRSKQKVAESSKLVRSRRGGGDEVASSEIEPNESRIRSKRLGKSKRKRVMGEAEAMDEAVKKMKLKRGDLQLDLIRMVLKREVEKRKRLPNSNNKKKSNGGFSEFVGEELTRVLPNGIMAISPPSPTTSNVSSPCDVKVGEEPISMIKRRFRSKNIEPLPIGKMQDSQSVRSDIDRVLHLHYAVCMLLPVLKEINAEHKVEVENDAEKKVDLQRMCTRSSSVLRLNSDQDQSQESLSRKVGSVKCSNGIKSPKVLLDFHQNNLEHFQTHWSKGHPVIVRSVIKSGSSLNWDPVALFCHYLMNRNNKTGNTTDCMDWFEVEIGVKQFFLGSLRGKAETNTCQERLKLEGWLSSSLFKEQFPNHYAEILNILPISHYMDPKRGLLNIAANLPDTVQPPDFGPCLNISYRSGEEYAQPDSVKKLGFETCDMVDILLYVTETPVSTNQICRIRKLMKNIGRVRSKNPAKGRESRFDKGKKRDRLDDYSSSDSESSQHCLGAKCRGSEFEGEERESCNYSCEEESLSNTYGAQWDVFQKQDVSKLLEYIKNHSLELESMDSSKKKVSHPLLEQSYYLDEYHKARLKEEFDVEPWSFDQCVGEAVILPAGCPYQIRKNKSCVNAVLKFLSPEHVSESIKRVKELNQLPQSVKSKANKIEVKKMAIHKISEAVKEIRELTSSDSTGALRLYN

SEQ ID NO: 96 - protein, 289 aa, Arabidopsis thaliana
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKDWSAVSNDNNNTLDFGFNYIDATVDNAFGGGGSSNQMFPLQDMFMYMQKPY

SEQ ID NO: 97 - protein, 216 aa, Arabidopsis thaliana
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 98 - protein, 284 aa, Arabidopsis thaliana
MGQDEVGSDQTQIIKGKRTKRQRSSSTFVVTAATTVTSTSSSAGGSGGERAVSDEYNSAVSSPVTTDCTQEEEDMAICLIMLARGTVLPSPDLKNSRKIHQKISSENSSFYVYECKTCNRTFSSFQALGGHRASHKKPRTSTEEKTRLPLTQPKSSASEEGQNSHFKVSGSALASQASNIINKANKVHECSICGSEFTSGQALGGHMRRHRTAVTTISPVAATAEVSRNSTEEEIEINIGRSMEQQRKYLPLDLNLPAPEDDLRESKFQGIVFSATPALIDCHY

SEQ ID NO: 99 - protein, 246 aa, Arabidopsis thaliana
MAPVGLPPGFRFHPTDEELVNYYLKRKINGQEIELDIIPEVDLYKCEPWDLAEKSFLPSRDPEWYFFGPRDRKYPNGFRTNRATRGGYWKSTGKDRRVTSQSRAIGMKKTLVYYKGRAPQGIRTDWVMHEYRLDDKDCDDPSSLQDSYALCRVFKKNGICSELESERQLQTGQCSFTTASMEEINSNNNNNYNNDYETMSPEVGVSSACVEEVVDDKDDSWMQFITDDAWDTSSNGAAMGHGQGVY

SEQ ID NO: 100 - protein, 145 aa, Arabidopsis thaliana
MEGYDNGSLYAPFLSLKSHSKPELHQGEEESSKVRSEGCSKSVESSKKKGKKQRYAFQTRSQVDILDDGYRWRKYGQKAVKNNKFPRSYYRCTYGGCNVKKQVQRLTVDQEVVVTTYEGVHSHPIEKSTENFEHILTQMQIYSSF

SEQ ID NO: 101 - DNA, 10 bp, Artificial Sequence
  Made in the lab
gtgcaatgag

SEQ ID NO: 102 - DNA, 10 bp, Artificial Sequence
  Made in the lab
caatgcgtct

SEQ ID NO: 103 - DNA, 10 bp, Artificial Sequence
  Made in the lab
aggatacgtg

SEQ ID NO: 104 - DNA, 10 bp, Artificial Sequence
  Made in the lab
tccctttagc

SEQ ID NO: 105 - DNA, 10 bp, Artificial Sequence
  Made in the lab
cggataactg

SEQ ID NO: 106 - DNA, 10 bp, Artificial Sequence
  Made in the lab
aggttctagc

SEQ ID NO: 107 - DNA, 10 bp, Artificial Sequence
  Made in the lab
tccgacgtat

SEQ ID NO: 108 - DNA, 10 bp, Artificial Sequence
  Made in the lab
ggaagacaac

SEQ ID NO: 109 - DNA, 10 bp, Artificial Sequence
  Made in the lab
agaagcgatg

SEQ ID NO: 110 - DNA, 10 bp, Artificial Sequence
  Made in the lab
ccatttacgc

SEQ ID NO: 111 - DNA, 18 bp, Artificial Sequence
  Made in the lab
uuuaaccgcatccttctc

SEQ ID NO: 112 - DNA, 20 bp, Artificial Sequence
  Made in the lab
tactaatacgactcactaaa

SEQ ID NO: 113 - DNA, 30 bp, Artificial Sequence
  Made in the lab
gactagctggaattcaaggatgcggttaaa

SEQ ID NO: 114 - DNA, 30 bp, Artificial Sequence
  Made in the lab
cagccaacggaattcatacgactcactaaa

SEQ ID NO: 115 - DNA, 40 bp, Artificial Sequence
  Made in the lab
  misc_feature (1)...(40): n = A,T,C or G
attcgaattccgaggcggccgacatgttttttttttttvn

SEQ ID NO: 116 - DNA, 39 bp, Artificial Sequence
  Made in the lab
aagcagtggtatcaacgcagagtgaattctacggccggg

SEQ ID NO: 117 - DNA, 23 bp, Artificial Sequence
  Made in the lab
aagcagtggtatcaacgcagagt

SEQ ID NO: 118 - DNA, 26 bp, Artificial Sequence
  Made in the lab
attcgaattccgaggcggccgacatg

SEQ ID NO: 119 - DNA, 519 bp, Cucurbita maxima
cgggggatccaaattaaattcaagctgaactcatccatttctctgcattattctcccaatcttcattcttaaaaatgtctggacgtggaaagggcggcaagggcttgggaaaaggaggagcaaagcgccacaggaaggttttgagagataacattcagggcattaccaagcctgccattcgccgtttagctcgtagaggcggtgtgaagcgtatcagtggattaatctatgaagaaaccagaggagttttgaagattttcctcgagaatgtgattcgcgatgctgtgacctatactgagcacgctaggaggaagacggtgactgccatggatgtggtttatgcattgaagaggcagggaaggactttgtatgggtttggaggttaggtcataggttaattttacgaatcattgtatatctgagatttggaaatctagtcattgatgttcttttagttttactcggaagtcgttcatcgttgttcttgcaatgaaattttaattgatcgtgtaaaaaaaa

SEQ ID NO: 120 - DNA, 1275 bp, Cucumis sativus
ggaagacaactccaagtcaggaaactgtttccaaccgtcgcagtttgacgcgtacttgtgttcatgaagtagcggttccggttgggtactcttctaccaaagatgagtcggttcatggaaccctacctaatccagtttacaatggtacaatggcaaaaacgtatccgtttacgctcgacccatttcagcaggtatcggtttcttgcttagaacggaacgaatctattttggtttctgcgcatacttcagctggaaaaactgcggttgctgaatatgccattgcaatggcttttagagacaagcagagggttatatatacttccccacttaaggctttgagtaatcaaaagtatagggaattgagtcaagagtttaaagacgtgggattgatgactggagatgtaactctttcgcctaatgctagttgtttagtaatgacgacggagatacttagggggatgctttacaggggttcggaagttttgaaggaagtagcatgggtaatttttgatgaaattcattatatgagagatagggaaagaggtgttgtttgggaagaaagtataatatttttaccaccggctatcaaaatggtcttcctttctgcaacaatgtccaatgccacagagtttgctgagtggatatgttatatacacaagcagccttgtcatgtggtgtacaccgatttccgaccaactcccttgcaacattatgtttttcctgcgggtggcaatgggttgtatcttgtggttgacgaaaacgaacagtttagggaggataattttctaaagttgcaggatacatttgctaaacaaaaacagattgttggccataggactgcaaatgggaaatctagtgggagaattgctaaaggtggcagtgcttccggaggttcggacatttataaaattgttaagatgattatggaacgaaattttcaaccagtcattgtcttcagtttcagtagaagagaatgtgaacagcatgcgatgtccatgtccaaacttgactttaatactcaagaagaaaaggatatggtggaacatattttcagaaatgcaattctctgtttgaatgaagaagatagagaactgcctgcaattgagttaatgttacctcttctccagagaggtattgctgttcatcattctgggcttcttccagtaattaaggagttagtggagcttcttttccaggaaggtcttgttaaggctctttttgccacagaaacttttgccatgggtttgaacatgccagcaaaaacagttgtcttcc

SEQ ID NO: 121 - DNA, 1086 bp, Cucumis sativus
ttcagttgctagtaatgaaagggaaattattcctgacatagaggttcaacagggagaaatcaagtatgtcttttctgatggaattggaaaaatatcaagcaaattcgccaaagaggttgctgcaaaatgtggtttccaagccgtcccgtctgcttttcaaattcgttatggtggatataagggtgttgttgctgttgatccgtactcaactataaaattatctctgaggaagagtatgtgcaaatttgaatcagacaacacaaaacttgacgtcttaggccatagcaaataccaaccatgcttccttaatcgtcaactgattactctcatgtctactctaggtgttagagacgaaatttttgagaaaaaacaaagtggagctgtagaacaattggatgccattttaacagatccattgaaggctcaagaagctttggagttgatgtctcccggagagaatactaatattctcaaggaaatgctcaaatgtggctatcaaccagatgtcgagccgtatctgtcaatgatgttacaagctttccgggcatcaaagttgctagagttacgcaccaaatcaagaatctttatcccaaatgggagagcgatgatgggatgtcttgatgagaccaggaccttggaatatgggcaggtatttgtgcaaatctccagtggtagacatcgaaatttatctgaatccttcgcattcaatagaattggtcgagaacaccatttagttattgaaggaaatgttacagttgctaaaaatccctgcctgcaccctggtgatgttcgtgtattaaaggctgtaaatatacctggtttgtaccatatggttgactgtgtagtttttcctcaaaaaggatcaaggcctcatccgaatgaatgctcaggtagtgatttagatggtgatatttactttgtctgttgggacaccgaattgatcccgtctcgacaaattccacctatggattatactcctgcacctccaaatgagttagatcgtgatgttacaactgaggatatccaagaatattttgtgaactacatggttaatgatagtcttggaatcattgccaatgctcatac

SEQ ID NO: 122 - DNA, 1352 bp, Cucurbita spp
ggtttctttgatcagttgaattcgtttcagtgccctagggtctgatatggctgatgctctttctgttattcctgcatttgtgctccgtaacctttctgataaactctatgagaaacggaagaacgctgctcttgaggttgagggaattgtgaagcaacttgcttcggctggagatcatgagaagataacggcggttatcaatctgctgaccaacgatttcactatgtcgcctcaagcgaatcataggaagggaggattgatagggcttaatttagcggccgcgaattcgcccttcaatgcgtctcaacatcttgagcaaatcgtacctcctgtgctcaattctttttctgatcaagatagcagagtgcgttattatgcatgtgaagctctatacaacattgcaaaggttgtcagaggcgattttataattttttttaaccagatatttgatgccttatgtaagctttcggctgattcagatgccaatgtacaaagtgctgctcatctcttggatcgtcttgtgaaggatattgttactgaaagtgatcagtttagcatcgaagagtttattccattgctgagggagcgtatgaatgtcctaaatccctatgtccgtcagtttttggttggatggatcactgtacttgatagcgtgccagatattgatatgttgggctttcttcctgattttcttgatggtttgtttaatatgttgagtgattcaagtcatgaaatccggcagcaagctgattctgctctttcggagtttcttcaagagataaaaaattctccatctgtagattatggccggatggctgagattctggtccagagggcttcttctcccgacgaatttactcgcttaacggctattacatggattaacgagtttgtaaaacttggtggagatcaactagtaccttattatgctgatattctgggagcaattctaccttccatagctgataaagaagagaagattagagtggttgcacgggaaactaatgaagagcttcgtaatatcaaggcatttccaactgaaggatttgatgttggtgctatcctttctattgctaggagacaattatctagcgaacatgaggccactaggattgaagcattatattggatatcaacacttttagacagacatcgaactgaggtattaatctatttggatgatatacttgacagccttcttcaagccctatctgatccttctgatgaggtggtgctccttgttctcgatgttcatgcttgcatagcgatagatcagcaacattttcgccaacttgttgtcttccaagggcgaattcgtttaaacctgcaggacgagaccctttagtgagggt

SEQ ID NO: 123 - DNA, 759 bp, Cucumis sativus
aagcgatggaaatttcgaagcgcaacaatcaagaacattagactatcttgctgtgtggcaggacatatcaaagttgcagaagctggtgaagatattcaagaaaccatggatattcttgttgacgatggtttggatcctatgtcacaggagtactcttacctaaaatataatctcctttatggtgggagctgttctaggtgtggagagtggtgtcgtttacctgtgattgcaccatgtaggcatcttctgtgccttgattgtgttgctctggacagtgaagggtgcacctttcctggctgtggtaaattatatgtgatgcagactcctgaaaccttagcacggccagaaaatcccaatccaaaatggcctgttcctaaggatcttattgagttgcaaccatcatataagcaagataactgggatcctgattggcaatcaacatctagcagtaaagttgcatatctcattgagagattaaaagatttaagtgaaacaaataatgaggctgctttgctccctccctcatcattgactaaatctggtgcactactacaggaagttgaccactcaagggctatcacttcagatcatgaaatagtcagagataaagttcttattttctctcaatttctcgagcatattcatgtcattgaacaacagttaaccattgcgggcatcagatttgctgggatgtatagtccaatgcatgctagtaataagatgaagtcattggccatgtttcagcatgatgcaagctgc

SEQ ID NO: 124 - DNA, 1167 bp, Cucumis sativus
aatttagcggccgcgaattcgcccttggaagacaactaagtatgttgaaaaggttcaggaaggaggagcaggattgagggagaacgaggaaattagtagttctcctgaaagacaatcgcccaagggatcatccaagaaagtaagattttcagaagatgtggagatctttccactagttgatgaccaaaatagtgggaaaactaaggaagatgacggtttaattagagggaagcggttttccaaagaagaagacgagatagtgaaaaaggctgtcttcgaatacattgagaaacacgctcttggtgatgaaggtctcaaaatggttcttcattgcagggagtatccagagatcaaaagttgttggaaggacataggaaaagccataccttataggccttatttgagtgtatattatagagctcacatcttgtttgaaagggatgagaagcgtaaatggactcatgaggaatatgaacttgttcgaaagtttcatgacacacatgggtcagattggaaaggattagccgatgtccttggaaaacacaggtttcatgtgaaagatacatggaggcgtataaaactccccaatatgaagaaagggcaatggacacaagacgagtaccagaaattatttgatttagttaacaaagacctgcgactcaaggcttatgaggaaaaaagatccaagcatgggatgcttcgtgacaatatctgctggggagcaatcagcgacgtgttgtccacaagatcaactgctctttgctgccagaaatggtatcgccagttaacatcgccaatggttgctgagaatgaatgggcagatgtagacgactaccggcttgttgatgctctctctagcttggatgcctactccattgaagatgtggaatgggaccaactgcttgaacacagagatggtgatgtatgtagaaagcggtggtctcaaatggtcaaacacataggtgataatgggaacaagtcattttctgaacaagttgaagtcctctcccagcgatatagcattgatgtacttgatgcaagagaagcctatgacaatgcgcctgtagttgattaggcaaagcatagttcaaatctcgtcaaatttcttttcattcaggaggtatagtatcaagatgtctaattgcagtaagttgtcttccaggggcg

SEQ ID NO: 125 - DNA, 321 bp, Cucurbita spp
gtgcaatgaggcctaaattacaacaatcaaaaatgaagaagaaaaagaggaggagaagcggcgaggtggattcattggagcagatagcgggtagcatacggtggttggcggaggtagtggtgcgctcggaacaagctagaatggagatgattaaggatatagaaaagatgagagctgaagcagaggccaaaagaggggagttggatctcaaaagaacacaaatcattgcaaatactcaattggagatagctaagctctttgcatctccaaccaacaaacctcttgttgatcattcttcaccactaagaattgctagaacct

SEQ ID NO: 126 - DNA, 746 bp, Cucurbita maxima
ttgattacatgggttaaaggtcagtcaagatgaagaaccagttgcagtaagcattgtctcatctggtgggtatgaggatgatacaaatgatgcagatgtgttaatctacagtggccagggtggagtgaacagaaaggataaggaatcaacagatcaaaagcttgaaaggggtaatcttgcactagagaagagcttgcatcgtggaaatgaggttagagtagttcgaggggtaagagattttagtaacccaacagggaagatctatgtttatgatggtctttataaaatccaagagtcttgggtagagaaagggaaatctggctgcaatgtatttaaatacaaactagtgcgattacctggacagcgggaagcattcttgacttggaaattagtccaacaatggaaggatgggaatgcatcccgaattggggttataataccagatctggcttctggcgcagaaagtcttcctgtttcacttgtgaatgatgttgacgatgagaagggccctgcatattttacgtattatgctggtctcaaatatttaaaacctgtatgctctacagagccttcagctggctgtaactgtattggtggatgccttccaggcaatctcaattgcccttgcatgcagaaaaatggtggatatctcccctatagttctaatggggttcttgcgagtcagcaatctatgatatatgaatgtggcgcctcatgtcaatgccctcccaattgcaggaatcgta

SEQ ID NO: 127 - DNA, 627 bp, Cucumis sativus
agaagcgatgcactaagcacttggctagaaacttgtccatccatagcgttatcaatatactccaactcgcaagaatgtgcgatgcaccggatctctcactcagctgtatgaaaatggtgtccacccacttcaaggccgttgagaaaacggaaggctggaaattcctgcaaaaacacgactcttggctcgagcttcaaattctgcagttcatggatgaatccgaattgaggaaaaagagatgcagaaggcagaggaaagagcagagggtttatcttcagctaagcgacgcaatggagtgtttagagcacatctgtaaagaagggtgcacaaacgttgggccgctggacgtggtacccacaaagaagcagccatgttctaaatactctacgtgtcgtggagttcaacttctgattaagcactttgcaacgtgtgagaacagagtccacggaggagcttgctggcggtgcaaacgaatgtggcagcttctacgcttgcatgcctccatctgccaccaatccgatgcttgcaaagtccctctttgcagacaattcaaacaaaaaatgaagcaagagaatgttgaaaaagaggatgcgaagtggaaactgctggtgaaaaaggtgttgtctt

SEQ ID NO: 128 - DNA, 1432 bp, Cucurbita spp
aggttctagcgttccaagtagcttaccttctgtgatgagatctgaatcaattggcaaccaatctggcttcattgactctggtcattcaccttcacaactaaagctgggtatccgggcagcttcggctattcatcctcattcccttccagaacatcctgatgggttgaacaacaatgttcactgcaattctatgaatgcaattgcaggaaacatcagtctacgaccacccgaaagagctgatagcaggcagctatgtggagtgaactttaatggtcgctcaattgaattaaatgaagatgtttttgcatctggaggtaacagagctggccccattccgggaccgcattatacatggggtaattcctaccggccccagcctccagctccaggtgttgtatggccaaattctccatcgtatatgaatggaatttctgctgctcataccccgacccaagtccatggagttccaagagcagcatctcatttgatgcacacagttctgcccatgaataatcaccatgttggatcagcaccagcagttaatccttctatttgggataggcagcatgcttatgctggggaattgtcaaaagcctctggttttcattcaggttctattgggaatatgaatctgcctaacaattcaccacaatctatggaatttttctctcgcatcttcccacaagttggtggaaattctgttgagcttcctatcccccaacgaaatgtaggactacaatcccatcatcagcggtgcatggtttttcctggacgaggccaagttcttccaatgatgaattcatttgactcttcaaacgaacgtggtagaagccgaagaactgaagctgcctctaatcaagcagataagaagcaatatgaacttgatattgatcgcatactgaggggtgaagacaatcgtactacacttatgataaaaaacattcctaacaaatatacttcaaagatgcttttggctgcaattgatgaacgccatcgaggaacttatgacttcatctatctgcccattgactttaagaacaaatgtaatgtgggatatgcgttcattaacatgactgatcctagcctaatcattccattctatgaggcatttaatggaaaaaaatgggagaaattcaatagtgagaaggtggcatcacttgcatatgctcgcatacagggaaaagctgctctcatcgctcatttccagaattcaagcttaatgaatgaggagaagcgatgtcggccaatccttttcaacactgatggccccaatgcaggcgatcaggttccgtttccaatgggggtaaatgttcgtactaggcctggaaaagcccgaagcagtaaccaggaggaaaaccatgatgaagctctagtaatttctgaaaacgatgagaattattccacgtggagacgcattgaagggcgaattcgt

SEQ ID NO: 129 - DNA, 673 bp, Cucurbita maxima
gggggcacttcagtttcagcattctcaagcacgagtcaaactacgaattcccttgagatcttctttactaatggctcgcactaagcaaactgccaggaaatccaccggaggaaaggctccgaggaagcaacttgcaaccaaggctgctaggaaatcggctccggcgaccggcggagtgaagaagccacacaggttcaggccggggacggtggcgttgagagagattcgcaagtatcagaagagtacggagcttctcattaggaaacttccgttccagagattggtgagggaaattgctcaagatttcaagactgaccttcgtttccagagcagcgctgtagcggctcttcaggaggctgctgaggcgtatctcgtcgggctcttcgaagacacaaatctttgtgccattcatgccaagagggtcaccattatgcccaaggacatccagctcgctagaagaattagaggcgagagggcttaagtctagttgtctatccatctgcatctagttgaagaaatcgagttcttaaacctgtctgatgaattcactctgtaaaatttgctttaaattaatggccatttgaaatttctctgttccaagtgtctgttgaatatagttttttttatgtgatttaatcaaaccttctcgaactgttagtaagcataaaaaaaa

SEQ ID NO: 130 - DNA, 1348 bp, Cucurbita spp
ggtaatcgcaactccgacgcaagttttcaccttctgattctcttcgccggtcgctccaatttcgtcgatcatggcgaatcaagctgaatcctccgactccaagggcacgaagaaggactttagcaccgccattttggagcggaagaaagccctaaatcgacttgtcgtcgatgaagcgatcaacgatgataactcggtcgtcgcgcttcatcctgataccatggagaaacttcaactcttccgcggggataccatcctcattaagggaaagaagaggaaagacacaatatgcattgctttagctgatgatacttgtgatgagcctaaaataaggatgaacaaagttgtgagaagcaatcttcgggttaggcttggagatgttgtctctgtgcaccaatgtgctgatgttaaatatgggaagcgtgttcatattcttcctgtggatgatactattgaaggggttactggaaatctttttgatgcatatttaaagccctatttcttggaggcatatcgtccattgaggaagggcgacctgttccttgtgagagggggaatgaggagtgtagagttcaaggttattgagaccgatcctgctgaatactgtgtggtagccccagacacagagatcttttgtgaaggggagcctgtgaaaagggaggatgaggatagattagatgaagttggttatgatgatgttggtggagttaggaaacaaatggctcagattcgtgaattggttgagctgccacttaggcatccgcagctgtttaaatcaattggtgtgaagccgcccaaaggaattttgctgtatggaccccctgggtctgggaagactttgattgcacgtgctgttgccaacgaaactggtgcatttttcttctgtatcaatggacctgagatcatgtcaaagttggctggtgaaagtgaaagtaacctcagaaaagcttttgaggaagcagagaaaaatgcaccatctattattttcattgatgaaattgattcaattgctcccaagcgagagaagaccaatggggaagttgagcgaagaattgtctcacagctactgacgctcatggatggattgaagtctcgtgcacatgtcattgtgattggtgctacaaatcgacccaacagcattgacccagctctgagaagatttggaagatttgatagggaaatagatattggtgtgcctgatgaagttgggcgtctagaagttctacgcattcactctaagaacatgaagcttgctgaagaggttgatttaaagaggattgccaaggatacacatggctacgttggtgctgatttggccgctctctgtactgaggctgctcttcaatgc

SEQ ID NO: 131 - DNA, 782 bp, Cucurbita maxima
  misc_feature (1)...(782): n = A,T,C or G
ggggatctcgatccggcggctctgaagattcggccgacggcggtggaggcggtggcggtaaactcggtgttcgatccacaccggttgttggctcgacctggagcgatagagaaggttttggggttgataaagacgacgcagccgaagatcgtgacgattgtggaacaggaagcgaaccacaacgggccgattttcctggaccggtttactgaggcgttgcattattactcgaacctgtttgactcgctcgaggggtcatcaatcgggttcgaacccgcgaatgaggacgtgttattgtccgaggtttatttggggagacagatttgcaacgtggtggcatgtgaaggaacggaccgagttgagcgacacgagtcattgactcagcggagaactcggattgaatcgtccgggtttgacccggtccatctcggttcgaacgcgttcaagcaggctagtatgcttttggccctctttgctggcggagaagggtacagggtggaggagaataatgggtgtttaatgcttggctggcacactcgaccgttgattgccacatcagcatggcaactcgctcccgatgggtcgaagtgagtcgactcactgggtgatgaatgagtttgtggacctgttttttctttttttctttttttttctgcctttttatttggagggtggattaatgatgatatataataaataatataatttttgggttatgaagctttacaataaatatggtgagcccttaatttaataatatttggagattttctgntnaacaa

SEQ ID NO: 132 - DNA, 687 bp, Cucurbita maxima
ggggcttcaaaagagattaggtcacctcccagctcggtttcgacacgccatgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataaaaacacttcacttcacattatattatcaaccaatatattgtaataacatggttcacgtttctatctaatagattatatatttttaataaaaaaaa

SEQ ID NO: 133 - DNA, 1011 bp, Cucurbita maxima
aagcgatgttgtaatcaaaggtagtattgctcacataacacaaatgaccatgcaacccaccttacgaaaactaatcattgactctcagaggtctgatgaacaccttggaaaaccgtgggatcagatatagattgaaaggccagtggggtactcaatctcttcagatgggggtttgctgtggacaaatcgcctgttccccgtgacaagaaaattcttaaggatattatgacagaagctcacgattcttcttatacgttccaccctggaagtacaaagatgtatcaggatcttaagggatgttattggttaccagggatgaaaaaggagatagcagattttgtaagccgatgcttgacctgtcagcaggtgaaggccccgagacagtgttcagtaggactgctacaacccttaaaggttccgcagtggaaatgggaagcagtttgcatggatcttatctcaggcttgcccaagaccaaacagagcttcaacgtaatctaggtagttgttgatagacttaccaaaatggctcacttcatcccaggcaaaaccacttatcgtgtggatcagtgggctcaattgtatatcagagagatagtacgcctgcatggtgtgctggtgtctatagtatctgatcgagacactaagttcatctcccaattttggaaaagcctccaaaaagcattggggactcagctaaagtttagtacaacattccatccttaaatggacggacaaaccgaaagactgaatcaaaccttagaagatatgttgcgagcctgtgtcatggatttcgctgggtgctgggatgaacatctaccactgatggagtttgcctacaataatagttaccaagcgaccatccagatggccccttttgaggcactgtatgggcgtaggtgttgaacactggtgttttgggaagaagtaggcacgtagcaactactgggaccagagttggttcaggccaccaacgcagcagtgcagaaaattaaacaaagaatcctcattgca

SEQ ID NO: 134 - DNA, 709 bp, Cucurbita maxima
aagaaagatggaatagtttgtaatgctgctctctgtaagcttggatgtgaacacaaaatttcgggctttattcgagacgaggctttcgatcctcaaaagtgggctattcctggtgatacacatgaagttcaccaattaacagaggaagtgctttctaatgggagaaaagtttatgttcggagaaaaagaaaggtaaaaggtaagaggatagctgacgttgttgaggcgctaatcggtgcatatcttagcactggtggggaaagggcagctattcagtttctaaatcggatcggtatagaagtgtattttgatattgtaccttacgagagaccttttagcgtcgatgcgcacaagctcattaatgtcagacatttagagttcctgctgaattacacgttcaatgatccctcattgttgttagaagcaatgactcatggttcatatatgtttcaagaaattccaagatgttatcagcgactggaatttcttggagactcggtattagattacgtcgttactgtgcatttgttcaacaaatatcccggaatgtcaccgggattgttgactgacatgaggtctgcgtccgtgaacaacgattgttatgcacgaactgcagtaaaggctcagctgtacaaaagtattctgcatttgtctcatgatctccacaagcatattagttcgacccttaaaaacttcgagatgttgtctt

SEQ ID NO: 135 - DNA, 704 bp, Cucurbita maxima
tgaaatgacaagtgaagatattgagaatgaatccaaggtttcgaatgtgccaggtcctagctctatggagactgatactcaaaagaaggaccagttgcctcaagtagaaccaatttcttcagaagaaacttctactgcttgtgatgacaattctgatagattagaattaagtcggctttacaatgagatgtgcaaggttttggatgaaaattgcaaagagctggtccatgcaccctctgggagccaccatgcagcttctgacttgaaaaataacctccttcccttggagaagatttttgaagacgtggaccgaattctttcttcacagtcaaaccccattaacgaacaaccaatgtcggtttctgatccacaacccgttgtcgttgaatcaccgagcaccgattttggtcttaaaccatcacttgcagatccagacagtgaaagggatgctgttgtcacagaaatggagatagatcctgcaaaagattcagaatcgaaaaaagaaagcgacaggttgatgccaatagatcttgatctcatcgacgaaaagcctgaaccatctgctcgagtagaaatggccgaatcatcttctcgtgttccagcttccgatgatccatgcccagatcagccagattctacacctctaccggagaaacgtagcgttgttgatgaaatggaagttgaagtgagcaaggacatcgctt

SEQ ID NO: 136 - DNA, 830 bp, Cucurbita moschata
gtgcaatgagatataacgatgaaaagaacgatgttcatgtgatggcaaaaaccttgctggaaaaatttgaagagaagtggctgcagcttttgcccaaagttgccgaggaggaaaaaagaaaagtggaggaggaagtcgagtttcagtttgatatgcagcatgcccaggaggcaacttacgctaacatggcaagagatataagcaatgagatttctgaggccgatatgaacttgaagggtctcagggaaatggttatccagagatgcaggaaaatgtccaccgaagagaagagaaaacttggaatagctctcacccgattgtcgcctgaagatctcacgaaggccctagaaatagttgccgagaacaatccaaactttcaagcaactgctcaggaagtggaccttgacattgatgctcagaatgagtacacattgtggcggttaaaagtttttgttaaagatgcacttgctataaaaagcaagagtgctgtagccatcgactccatcgacaatgataacattgatgataacaagaagaataactcgaaagggagaagagaaatttgtgatgccgttgtcaaatctgctataaaaaggacaaaaaaagttgtctaatatgtattcgactattgttggcactaatggcgttctttgcatccagtcatcagtttgtaattagagtgagaaagatgaagctacttgcaccaggtggctatttccatctgcctattgaatacgttatgtgtgtgtgtgtatgtataaagcttcctattgaatatgcccttataaacgctcttcttaaatagttgaaatttttacaattgccccaca

SEQ ID NO: 137 - DNA, 697 bp, Cucurbita moschata
ggatggactttcaaccctcctgcccgacacacaggcgaatgcttgtgatattgtggaggatggtagttttaccattgatgcggcaaattatggtaatattgggagatttatcaaccatagttgctcacccaatctttacgcccaaaatgttctttatgatcacgaggataagcgaattccacatattatgttctttgctgccgagaatattcctcccttacaggagctatcttaccattacaattatatgatcgatcaagttcgtgattctgatggaaatgttaaaaagaagagatgtcactgtggttccgtggagtgtactggttggatgtattgagttttggccaagaagttccaatcaatcaacagaattgtatgtttcttcttaggtagaagaaaggatcggaaacttgctatcttttccaagtagccgtcgttcgagcctactttttatgcttgttctcaacccatgactaatatgagctcgaagtttctttcgtaactcccgaaacttcttcgtagtggctccgttcagaacagagatgccttggaggcaggagttactgacttgtgctattttgagttggaagtttcagcagaaaatgaacaagaccacgtacttggttccatcggatttttgttttaaaggcaatgtataatgaaaagaatgcttttcttaacacaacaggcatcgctt

SEQ ID NO: 138 - DNA, 402 bp, Cucumis sativus
acgattcctgtttccccttttaactccaatccggtctgcaattattcgaagacaagtgtatttcccagacagaaggttaatacaatttgactgcggcaaattgcaggaacttgctattctacttaggaaactaaaatctgaaggtcaccgagcattaatattcactcaaatgacaaaaatgcttgatatcttggaggcgttcatcaatctgtatggttacacttacatacgtctggatggatccactcagcctgaagagagacagacattaatgcaacgatttaacaccaaccctaaaatttttcttttcatcttatcgactcgcagtgggggtgtaggtatcaatcttgttggtgcagacactgttatcttttacgacagtgattggaaccctgctatgga

SEQ ID NO: 139 - DNA, 685 bp, Cucumis sativus
ttctagcactaccggattttcaattgccattttaaatagaaacagacgcttcagggttcggtctcggggcagttttatcacaaaataagagacctattgcatactttagccagagactcttcgagacagccaaagagagatccatttatgagagagagctaatggcaattgtattagcggttgagaaatggtgacactacttgttgggacatcgctttattgtatacattgaccaaaaagccttgcggcatatcttggagcaaaggaagattttgtcgggcatccaaaaatgggtaatgaaattgatcggcttcgatttcaaaatcttttatcgagtgggaccggagaacaaggcagcagatgcactttcgcgaattccgagtaccctccttgttggatctcgaggcagtggagaaaaaagttcaagaggatgagacgctaaaaaatatatttgaacgagtgattcaggacccagaatgtgtgcctcattatgtggtacgccatggcaaattattcttcaaaggcaaattggttctcccaaggacatccagcttaattctgaccatcctccacaccttctacaattccgtgattaggggccatttggggcagttacgaacatataagagaattgcggcagaactgttttgggaaggaaatgagagtgacatcaaaatttacgttg

SEQ ID NO: 140 - DNA, 611 bp, Cucurbita maxima
  misc_feature (1)...(611): n = A,T,C or G
cggggnatcctttatttttcattcaaaatattactgagtttgaacttcatctctttctgtatccaaatttcgacaaatcaatggcgggaagaggcaaaactttaggatctggagcgtcgaagaaggccacttcaaggagtagcaaggccggccttcaatttcccgtcggtcgtattgctcgtttcttgaaagccggtaaatacgctgaacgagtcggtgctggagctccggtttacctcgccgccgtcctcgaatatcttgcagcggaggttctggaattggctggaaatgccgcaagggacaacaagaagactagagttgtgcctcgccatatccagcttgctgtgaggaacgacgaagagctgagcaagcttcttggagatgtaacgattgcgaatggcggtgttatgcctaacattcacaatctgctattgccaaagaaggctggtagttccaaggcgtctggtggtgaggatgaatcctaaattaaatgaagaaacgtggtcgaggtgttcagatctggagtttaggtttgttagctttgtgtgctttactttaatgtgttcttaactntaatcaaagagctgatgtgcatacgatcaatcttcttc

SEQ ID NO: 141 - DNA, 610 bp, Cucurbita maxima
catacatttatacaaatggaaacaaggggtgatgaaggaggtatctgaaggtaaactagctacctcagcagacagcagatgcatgggtgcagctttaactaaagctcacacttctctgttaagagtgctaattacggagcttcaatccaaggtagctgctcttgtggatccaaattttgattctggagagtcaaaaccaaaacgaggaaggaaaaaggatgtggatagtgcaacttctattaggaaaacaaagctgaatttgctccctctcaatgaactaacatggccagaattagcccgccgttacatcttggctgtcttatccatggatggtaatcttgagtcagctaaagtaactgctcgtgaaagtggaagagtatttcgatgtctacaaggtgatggtggtgtgctttgtggctctctcacgggagtggctgggatggagtcagatgcatttcttctggctgaggctacaaaccaaatatatggatcgttaaatagagaaaagcatgttattacattagaagaggaagactctgatgccaccggtggttgtgagaaggtgctggcgactgatggtaagatgccagagtgggcacaagtgctagaa

SEQ ID NO: 142 - DNA, 1124 bp, Cucurbita spp
ttctagcagattatgttcatagaaaagggctcaagctcggaatttactctgatgctggtatccagacttgcagtaagaagatgccaggttccttggatcacgaagaacaagatgcaaaaacctttgcatcatgggggatcgattacttgaaatatgataactgtgaaaatactggtacaagcccaaaagaaaggtatccgaagatgactaaagccttgcaacaatctgggagacccatacttttttctttatgtgaatggggacaagaagacccagctacttgggcagtgaatgtaggaaatagttggagaacaacatcagatatggaagacaactggaacagtatgacaactattgctgatcagaatgacaaatgggcatcttatgctaaacctggaggatggaatgatcctgacatgcttgaagtggggaacggagggatgacaacagcagaataccgctctcattttagcatttgggcactggcaaaagctcctttgctgattggatgtgacatcagatcaatggacaacatcaccttgaaattgttaagtaataaggaggttattgcagttaatcaggataagcttggagttcaagggaagaaggtttacaaacttggagatcttgaggtttgggcagggacacttagtggtaaaagagtcgctgtggttctgtggaacagaggcttttatagagccaaaatcactgcatcttggtcagctattggtttgagtccatcaactactgttacttcccgagacttatgggagcactccagtcaggtggttcagcatcaacttactgctcaagtagaccctcatgactgtaagatgtatgttctcactccccattaaagcccaaagagaaaacaccgccaatgttcttgtgattgattattgttgtcttccattcagtctctatgctgtgtttcctgggattttacatgctttatctgtttgagatgaggtctttatttcttcaatgtggatgaacaaatgctctttggaatttttatttgttaggtacttacatagttgttctctatttggaacatagacatcaaatgcatttgtgcttcattccacttcctattatgtgatcaagcttttgatgttgaacgg

SEQ ID NO: 143 - DNA, 580 bp, Cucurbita maxima
aaatgtcacataaagttcctggaaacacaaggtattgcaggagttagtcaccacaatttgctcttctccaagacagctccagaacctgtgcacgtattggaggaagaagaggcatctttcaggaggaataaggagtttgcttttggtgaaagagcaacttcaagttcttcacccgatcctgatacagatggggcaaggtttgcttttaacccaaagaatgtgaagttgaatagatttgctacaaatgcaagcagtccaagcaagccgactgaaagggaaatcaaagagagaatcaatcggctgtcccaaactctagaaaataaggtccttatctcaagattaccagacaggggagaaagaattcagaagcaaattgttgaactgaatttacagctttctgaattgaagagaaaagaacatgaaagtgaagtcatcgacatcaccgacgagtttcagaaggtgctgaatgtatagtttgtattgtgatgtgaagactgaatcttctcatgagtgaggcatgaggctgactatatatgtattttgagacaactgaggttttgttctttaatatgctacacca

SEQ ID NO: 144 - DNA, 673 bp, Cucurbita maxima
cacatgggaaggtaggtcgctggacccgtgcataccatttaaaagtgcctcttccacccatgcccccacaacctgcccgaggtggccctcgtcagaggattcttcctacccctcgtggtgtaaatatgataatttggagcctagataatcgttttgtcttagcagctataatggattgtagaatttgtgtttggaatgcctctgatgggagcttagtgcactctttgacgggtcatactgaatctacgtatgtactcgatgttcatccttttaatccaaggattgctatgagtgctggatacgatggaaaaacaatagtttgggatatttgggaaggcacgccaattcggatatatgaaatttctcatttcaaactggttgatgggaagttttcttcagacgggacatcaattatactttcagatgatgttgggcagctatatatattaagcaccggtcagggagaatcccaacaggatgccaagtatgatcagttctttcttggtgactatcgcccacttattcaggatcctttcggcaatgtagttgaccaagaaacccaactcagtacttacagacggaatttgcaagatctcctttctgactcaggcatgataccttatccggaaccttatcagactgcatatcagcaaagacgtttaggtgctatgga

SEQ ID NO: 145 - DNA, 365 bp, Cucurbita moschata
gtgcaatgagaaggctgcatttgagagacccatgtatgctgaagcatattgcaacatgggcgtaatatataaaaaccgtggggacctagagtcagctattgcttgttatgagaggtgcctagctgtttcaccaaatttcgagattgcgaagaataatatggcaattgccttgacagatttaggaacaaaggttaaactggagggtaatatagcccagggtgtagcatattataagagagctctgtattacaattggcactatgctgatgctatgtacaatcttggggttgcatatggtgaaatgcttaaatttgacatggctattgttttttatgagctagctttccatttcaatcctcattgca

SEQ ID NO: 146 - DNA, 618 bp, Cucurbita moschata
cagataggattcaactgttgtgcacaagttctcttaagatcagtgcttgctgagaaacaagaattatgtttctctgttatttctctactgtggcataagttaattacagctccagaaactcaaccgagcgtggagagcacttcagcgcagcaaggatggagacaggtagttgatgcattatgcaacgtggtatcagcttccccagctaaagcagctacagcaattgtccttcaggcggagaggcagttgcaaccttggattgcaaaagacgatgatcaaggtcagaagatgtggagaatcaaccagcggatcaccaaactcatagttgagctaatgagaaatcacgatactccagaatcgctggtcgtattggcgagtgcgttagatctactgttgcgtgccacagatggcatgcttgtagatggtgaagcctgtactttgccacaactagagctattggaagcgactgctagagcagttaagcctgtactggagtggggagaatctggactgtcaattgctgatggcctttccaatctcttaaagtgtcgtctaccagctactgttcgatgcctatctcatccaagtgcgcacgtccgagccttaagcacatcgctt

SEQ ID NO: 147 - DNA, 600 bp, Cucurbita moschata
acactagcgcgtaccttgaagaagtgttctcaaaatgataatgggactgaaaatgaagagtctatctcagatatcgatcttgagatactgttggcgctgggaacacttcagagctggaggaaatggatccacctagtgctctgctatgtgaacttcggccctaccaaaagcaggctcttcattggatgatccatctggagaaaggaaagtgcatggatgaggctgcaacaacccttcatccatgttgggaagcttatcgtctaatagacgagagggagcttgtcatctatttaaattctttttctggtgaagcaacgacagagttcccaagcactcttcaaattgccagaggagggattctggctgatgccatgggccttgggaagaccatcatgaccatatcccttcttcttgcccattcagaaagaggtggagtatccaatagtcagctgacatgttcctcagttgaaggagatgatggaagtatggaccaatctttgaatcctttgaagaaggctaaaattacaggttttgagaagttgcagaagaggaacaccttagcaagcggcggcaatctgattatttgtcccatgtcccttc

SEQ ID NO: 148 - DNA, 633 bp, Cucurbita moschata
cgattcctggagtgcacattggcgatctgttcttctttaggatggaattgtgtgttgttggattgcacggtcaggctcaagctggaattgactatgtccctgcgagtcagagctccaacggcgagccaattgccactagcgtgattgtttctggtggggatgaggacgatgaggattctggagacacgataatctatacgggtcatggtgggcaagacaaattttcaaaacaatgtatgcaccagaagcttgaaggtgggaaccttgcactggagagaagcatgcactacgggattgaagtgagggtaatacgaggtatgaagtacgccggcagtgtaacaagtaagatttatgtatacgatggtctatatagaattctcgaatgttggtttgatgtggggaagtctggttttggtgtttacaagtttaagcttctaaggattgatggtcaagccgaaatgggtagctccattttgaaatttgcagagaacctcaggtctaaaccattgtctttgaggccttctggttatctcagtctcgatatttcaatgaagaaggaggctgttccagttctcctcttcaatgatattgacaacgatcaagaaccattgtattatgagtatcttgttggga

SEQ ID NO: 149 - DNA, 695 bp, Cucumis sativus
gcaggtgtaaacaagccatggggttttgcctccataacaatgcggcagtttctgcattggcagctcaggctgctggtgctaagaaggtgttaatagttgattgggatgttcatcatggaaatggaacacaggaaatatttgagcaaaataaatcggtcttgtatatatctttacataggcatgagtttggtagattctatcctggaacaggagctgctgatgaggttggcactatgggagcagaaggatattgtgtaaatgttccttggagtcggtcaggagttggtgataacgattacatttttgcgtttaagcaagttgtgcttcccatagcttctgcttttgcccctgatctcactatcatatcagcagggtttgatgctgctaggggtgatccattgggaatgtgtgatgtaactcctaccggctataatcttcgttccatttcatcttcagctactgcagttatcaaggtattgctgggtgaaagtcctgaatgtgacttggatgatcacttaccctccagcgctgggatgaaaacagtattagatgtgcttgcgattcaaaaaaatttctggcccgtgctggaatctagcttttcaaaactgcagtcaatgttggagatatttgccaccgaaagaagaggaaaagtaaaaccatgtaagcagagaagacgtgctgtggtggctccgatt

SEQ ID NO: 150 - DNA, 919 bp, Cucurbita maxima
ggcgaccaaaaagaggggcttcgttttgtgaatggtttgggaggaagataaaaggagagtgaagagaagagagtaagaggaattagggttgactgttgagacacgagagaaatgggacggaagaagatcgaattgaagcggatcgaagatatgtgtaatcgccatgtgactttctgcaagagaagatctggattaatcaagaaggctcgagaactctctgttctctgcgacgttgaggtcggactcgtcatcttcaccaaccgcggccgtctctatgagttttgcagcggcgacagcttattgaatattattaagcgctaccaaagccactttgaagggagaagtgaaagtcaaaacgaggttgatacaaaggagaatgaagaatctgatgagacactcatggtgtcatttggaaagctcctacaaactattcaaagtcatgttgaagaaccagatttcaaaaagctcaatgtaaatgatatggtgcacctggagaatcaacttgaagcctcacttgacaaaatcaaatctcaaagagttgaggcaatgatggaaaatagcagttggatagacaaaatggatatggctatcgccatggtcgacagccaactttaattagtgaagtgcctcgaacaacaatgtggttgatattgtagtcccaaataaaataaagagaagctgcacaattgtatgagttcctaacaccctgctaaactgcaaaagcaaatcagcatactatgtgacatctgaatatacatataatggttctagcataatatcaggtaaaatgaccacgcagcagcaaacacttacttgatgcctgcataattaaattttatccattaatgcttgtaattttccataaaactttatttagtgaaatcttcttggtgtcaaaaaaaaactgagactagttccc

SEQ ID NO: 151 - DNA, 705 bp, Cucurbita spp
tagaagcgatgaagagggaaaatttgccccttccctggaaactcttgaaattagcaggaccaagattgttaagtcaattccaaactattttggtggtgaagatgaagatggtattcctgaccttgctgatattgaagaaaatgatgacgctcttgcaactgatgcagccactctgccattgacctaccaaattgcccatgaacctgatgacgataatatccttcgaacacgaacttatgatgtcagcatcacgtatgataaatattatcagacaccacgtgtttggctgacaggatatgatgagtcaaggatgctcttacagccagaacatgtgcttgaagatgttagtcaagatcatgcacgaaaaacggtgaccattgaggaccatccccacctacctggaaagcatgcatctgtacatccctgcagacatggggctgtgatgaaaaagatcattgatgtgttgatgtcccggggcgtagaaccggaagttcacaagtatcttttcttgttcttaaaatttgtcgcgtctgttattccgactatcgaatatgattatactatggacgttgatcttggaggccctagccgtcgataactgggattgatgaatattgacactctgctcatgtccgattatacatatgtggggtatttcacatctgatgtttctgtaaatgcaggctgacactctgctcattgcac

SEQ ID NO: 152 - protein, 103 aa, Cucurbita maxima
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 153 - protein, 424 aa, Cucumis sativus
KTTPSQETVSNRRSLTRTCVHEVAVPVGYSSTKDESVHGTLPNPVYNGTMAKTYPFTLDPFQQVSVSCLERNESILVSAHTSAGKTAVAEYAIAMAFRDKQRVIYTSPLKALSNQKYRELSQEFKDVGLMTGDVTLSPNASCLVMTTEILRGMLYRGSEVLKEVAWVIFDEIHYMRDRERGVVWEESIIFLPPAIKMVFLSATMSNATEFAEWICYIHKQPCHVVYTDFRPTPLQHYVFPAGGNGLYLVVDENEQFREDNFLKLQDTFAKQKQIVGHRTANGKSSGRIAKGGSASGGSDIYKIVKMIMERNFQPVIVFSFSRRECEQHAMSMSKLDFNTQEEKDMVEHIFRNAILCLNEEDRELPAIELMLPLLQRGIAVHHSGLLPVIKELVELLFQEGLVKALFATETFAMGLNMPAKTVVF

SEQ ID NO: 154 - protein, 361 aa, Cucumis sativus
SVASNEREIIPDIEVQQGEIKYVFSDGIGKISSKFAKEVAAKCGFQAVPSAFQIRYGGYKGVVAVDPYSTIKLSLRKSMCKFESDNTKLDVLGHSKYQPCFLNRQLITLMSTLGVRDEIFEKKQSGAVEQLDAILTDPLKAQEALELMSPGENTNILKEMLKCGYQPDVEPYLSMMLQAFRASKLLELRTKSRIFIPNGRAMMGCLDETRTLEYGQVFVQISSGRHRNLSESFAFNRIGREHHLVIEGNVTVAKNPCLHPGDVRVLKAVNIPGLYHMVDCVVFPQKGSRPHPNECSGSDLDGDIYFVCWDTELIPSRQIPPMDYTPAPPNELDRDVTTEDIQEYFVNYMVNDSLGIIANAH

SEQ ID NO: 155 - protein, 432 aa, Cucurbita spp
MADALSVIPAFVLRNLSDKLYEKRKNAALEVEGIVKQLASAGDHEKITAVINLLTNDFTMSPQANHRKGGLIGLNLAAANSPFNASQHLEQIVPPVLNSFSDQDSRVRYYACEALYNIAKVVRGDFIIFFNQIFDALCKLSADSDANVQSAAHLLDRLVKDIVTESDQFSIEEFIPLLRERMNVLNPYVRQFLVGWITVLDSVPDIDMLGFLPDFLDGLFNMLSDSSHEIRQQADSALSEFLQEIKNSPSVDYGRMAEILVQRASSPDEFTRLTAITWINEFVKLGGDQLVPYYADILGAILPSIADKEEKIRVVARETNEELRNIKAFPTEGFDVGAILSIARRQLSSEHEATRIEALYWISTLLDRHRTEVLIYLDDILDSLLQALSDPSDEVVLLVLDVHACIAIDQQHFRQLVVFQGRIRLNLQDETL

SEQ ID NO: 156 - protein, 253 aa, Cucumis sativus
KRWKFRSATIKNIRLSCCVAGHIKVAEAGEDIQETMDILVDDGLDPMSQEYSYLKYNLLYGGSCSRCGEWCRLPVIAPCRHLLCLDCVALDSEGCTFPGCGKLYVMQTPETLARPENPNPKWPVPKDLIELQPSYKQDNWDPDWQSTSSSKVAYLIERLKDLSETNNEAALLPPSSLTKSGALLQEVDHSRAITSDHEIVRDKVLIFSQFLEHIHVIEQQLTIAGIRFAGMYSPMHASNKMKSLAMFQHDASC

SEQ ID NO: 157 - protein, 355 aa, Cucumis sativus
RPRIRPWKTTKYVEKVQEGGAGLRENEEISSSPERQSPKGSSKKVRFSEDVEIFPLVDDQNSGKTKEDDGLIRGKRFSKEEDEIVKKAVFEYIEKHALGDEGLKMVLHCREYPEIKSCWKDIGKAIPYRPYLSVYYRAHILFERDEKRKWTHEEYELVRKFHDTHGSDWKGLADVLGKHRFHVKDTWRRIKLPNMKKGQWTQDEYQKLFDLVNKDLRLKAYEEKRSKHGMLRDNICWGAISDVLSTRSTALCCQKWYRQLTSPMVAENEWADVDDYRLVDALSSLDAYSIEDVEWDQLLEHRDGDVCRKRWSQMVKHIGDNGNKSFSEQVEVLSQRYSIDVLDAREAYDNAPVVD

SEQ ID NO: 158 - protein, 106 aa, Cucurbita spp
AMRPKLQQSKMKKKKRRRSGEVDSLEQIAGSIRWLAEVVVRSEQARMEMIKDIEKMRAEAEAKRGELDLKRTQIIANTQLEIAKLFASPTNKPLVDHSSPLRIART

SEQ ID NO: 159 - protein, 247 aa, Cucurbita maxima
LHGLKVSQDEEPVAVSIVSSGGYEDDTNDADVLIYSGQGGVNRKDKESTDQKLERGNLALEKSLHRGNEVRVVRGVRDFSNPTGKIYVYDGLYKIQESWVEKGKSGCNVFKYKLVRLPGQREAFLTWKLVQQWKDGNASRIGVIIPDLASGAESLPVSLVNDVDDEKGPAYFTYYAGLKYLKPVCSTEPSAGCNCIGGCLPGNLNCPCMQKNGGYLPYSSNGVLASQQSMIYECGASCQCPPNCRNR

SEQ ID NO: 160 - protein, 208 aa, Cucumis sativus
KRCTKHLARNLSIHSVINILQLARMCDAPDLSLSCMKMVSTHFKAVEKTEGWKFLQKHDSWLELQILQFMDESELRKKRCRRQRKEQRVYLQLSDAMECLEHICKEGCTNVGPLDVVPTKKQPCSKYSTCRGVQLLIKHFATCENRVHGGACWRCKRMWQLLRLHASICHQSDACKVPLCRQFKQKMKQENVEKEDAKWKLLVKKVLS

SEQ ID NO: 161 - protein, 477 aa, Cucurbita spp
GSSVPSSLPSVMRSESIGNQSGFIDSGHSPSQLKLGIRAASAIHPHSLPEHPDGLNNNVHCNSMNAIAGNISLRPPERADSRQLCGVNFNGRSIELNEDVFASGGNRAGPIPGPHYTWGNSYRPQPPAPGVVWPNSPSYMNGISAAHTPTQVHGVPRAASHLMHTVLPMNNHHVGSAPAVNPSIWDRQHAYAGELSKASGFHSGSIGNMNLPNNSPQSMEFFSRIFPQVGGNSVELPIPQRNVGLQSHHQRCMVFPGRGQVLPMMNSFDSSNERGRSRRTEAASNQADKKQYELDIDRILRGEDNRTTLMIKNIPNKYTSKMLLAAIDERHRGTYDFIYLPIDFKNKCNVGYAFINMTDPSLIIPFYEAFNGKKWEKFNSEKVASLAYARIQGKAALIAHFQNSSLMNEEKRCRPILFNTDGPNAGDQVPFPMGVNVRTRPGKARSSNQEENHDEALVISENDENYSTWRRIEGRIR

SEQ ID NO: 162 - protein, 136 aa, Cucurbita maxima
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 163 - protein, 426 aa, Cucurbita spp
MANQAESSDSKGTKKDFSTAILERKKALNRLVVDEAINDDNSVVALHPDTMEKLQLFRGDTILIKGKKRKDTICIALADDTCDEPKIRMNKVVRSNLRVRLGDVVSVHQCADVKYGKRVHILPVDDTIEGVTGNLFDAYLKPYFLEAYRPLRKGDLFLVRGGMRSVEFKVIETDPAEYCVVAPDTEIFCEGEPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHSKNMKLAEEVDLKRIAKDTHGYVGADLAALCTEAALQC

SEQ ID NO: 164 - protein, 196 aa, Cucurbita maxima
GDLDPAALKIRPTAVEAVAVNSVFDPHRLLARPGAIEKVLGLIKTTQPKIVTIVEQEANHNGPIFLDRFTEALHYYSNLFDSLEGSSIGFEPANEDVLLSEVYLGRQICNVVACEGTDRVERHESLTQRRTRIESSGFDPVHLGSNAFKQASMLLALFAGGEGYRVEENNGCLMLGWHTRPLIATSAWQLAPDGSK

SEQ ID NO: 165 - protein, 180 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 166 - protein, 270 aa, Cucurbita maxima
  VARIANT (1)...(270): Xaa = Any Amino Acid
VPRDKKILKDIMTEAHDSSYTFHPGSTKMYQDLKGCYWLPGMKKEIADFVSRCLTCQQVKAPRQCSVGLLQPLKVPQWKWEAVCMDLISGLPKTKQSFNVIXVVVDRLTKMAHFIPGKTTYRVDQWAQLYIREIVRLHGVLVSIVSDRDTKFISQFWKSLQKALGTQLKFSTTFHPXMDGQTERLNQTLEDMLRACVMDFAGCWDEHLPLMEFAYNNSYQATIQMAPFEALYGRRCXTLVFWEEVGTXQLLGPELVQATNAAVQKIKQRI

SEQ ID NO: 167 - protein, 236 aa, Cucurbita maxima
KKDGIVCNAALCKLGCEHKISGFIRDEAFDPQKWAIPGDTHEVHQLTEEVLSNGRKVYVRRKRKVKGKRIADVVEALIGAYLSTGGERAAIQFLNRIGIEVYFDIVPYERPFSVDAHKLINVRHLEFLLNYTFNDPSLLLEAMTHGSYMFQEIPRCYQRLEFLGDSVLDYVVTVHLFNKYPGMSPGLLTDMRSASVNNDCYARTAVKAQLYKSILHLSHDLHKHISSTLKNFEMLS

SEQ ID NO: 168 - protein, 234 aa, Cucurbita maxima
EMTSEDIENESKVSNVPGPSSMETDTQKKDQLPQVEPISSEETSTACDDNSDRLELSRLYNEMCKVLDENCKELVHAPSGSHHAASDLKNNLLPLEKIFEDVDRILSSQSNPINEQPMSVSDPQPVVVESPSTDFGLKPSLADPDSERDAVVTEMEIDPAKDSESKKESDRLMPIDLDLIDEKPEPSARVEMAESSSRVPASDDPCPDQPDSTPLPEKRSVVDEMEVEVSKDIA

SEQ ID NO: 169 - protein, 203 aa, Cucurbita moschata
AMRYNDEKNDVHVMAKTLLEKFEEKWLQLLPKVAEEEKRKVEEEVEFQFDMQHAQEATYANMARDISNEISEADMNLKGLREMVIQRCRKMSTEEKRKLGIALTRLSPEDLTKALEIVAENNPNFQATAQEVDLDIDAQNEYTLWRLKVFVKDALAIKSKSAVAIDSIDNDNIDDNKKNNSKGRREICDAVVKSAIKRTKKVV

SEQ ID NO: 170 - protein, 111 aa, Cucurbita moschata
DGLSTLLPDTQANACDIVEDGSFTIDAANYGNIGRFINHSCSPNLYAQNVLYDHEDKRIPHIMFFAAENIPPLQELSYHYNYMIDQVRDSDGNVKKKRCHCGSVECTGWMY

SEQ ID NO: 171 - protein, 133 aa, Cucumis sativus
RFLFPLLTPIRSAIIRRQVYFPDRRLIQFDCGKLQELAILLRKLKSEGHRALIFTQMTKMLDILEAFINLYGYTYIRLDGSTQPEERQTLMQRFNTNPKIFLFILSTRSGGVGINLVGADTVIFYDSDWNPAM

SEQ ID NO: 172 - protein, 128 aa, Cucumis sativus
  VARIANT (1)...(128): Xaa = Any Amino Acid
LALPDFQLPFXIETDASGFGLGAVLSQNKRPIAYFSQRLFETAKERSIYERELMAIVLAVEKWXHYLLGHRFIVYIDQKALRHILEQRKILSGIQKWVMKLIGFDFKIFYRVGPENKAADALSRIPST

SEQ ID NO: 173 - protein, 134 aa, Cucurbita maxima
MAGRGKTLGSGASKKATSRSSKAGLQFPVGRIARFLKAGKYAERVGAGAPVYLAAVLEYLAAEVLELAGNAARDNKKTRVVPRHIQLAVRNDEELSKLLGDVTIANGGVMPNIHNLLLPKKAGSSKASGGEDES

SEQ ID NO: 174 - protein, 203 aa, Cucurbita maxima
IHLYKWKQGVMKEVSEGKLATSADSRCMGAALTKAHTSLLRVLITELQSKVAALVDPNFDSGESKPKRGRKKDVDSATSIRKTKLNLLPLNELTWPELARRYILAVLSMDGNLESAKVTARESGRVFRCLQGDGGVLCGSLTGVAGMESDAFLLAEATNQIYGSLNREKHVITLEEEDSDATGGCEKVLATDGKMPEWAQVLE

SEQ ID NO: 175 - protein, 284 aa, Cucurbita spp
LADYVHRKGLKLGIYSDAGIQTCSKKMPGSLDHEEQDAKTFASWGIDYLKYDNCENTGTSPKERYPKMTKALQQSGRPILFSLCEWGQEDPATWAVNVGNSWRTTSDMEDNWNSMTTIADQNDKWASYAKPGGWNDPDMLEVGNGGMTTAEYRSHFSIWALAKAPLLIGCDIRSMDNITLKLLSNKEVIAVNQDKLGVQGKKVYKLGDLEVWAGTLSGKRVAVVLWNRGFYRAKITASWSAIGLSPSTTVTSRDLWEHSSQVVQHQLTAQVDPHDCKMYVLTPH

SEQ ID NO: 176 - protein, 157 aa, Cucurbita maxima
KCHIKFLETQGIAGVSHHNLLFSKTAPEPVHVLEEEEASFRRNKEFAFGERATSSSSPDPDTDGARFAFNPKNVKLNRFATNASSPSKPTEREIKERINRLSQTLENKVLISRLPDRGERIQKQIVELNLQLSELKRKEHESEVIDITDEFQKVLNV

SEQ ID NO: 177 - protein, 223 aa, Cucurbita maxima
HGKVGRWTRAYHLKVPLPPMPPQPARGGPRQRILPTPRGVNMIIWSLDNRFVLAAIMDCRICVWNASDGSLVHSLTGHTESTYVLDVHPFNPRIAMSAGYDGKTIVWDIWEGTPIRIYEISHFKLVDGKFSSDGTSIILSDDVGQLYILSTGQGESQQDAKYDQFFLGDYRPLIQDPFGNVVDQETQLSTYRRNLQDLLSDSGMIPYPEPYQTAYQQRRLGAM

SEQ ID NO: 178 - protein, 121 aa, Cucurbita moschata
CNEKAAFERPMYAEAYCNMGVIYKNRGDLESAIACYERCLAVSPNFEIAKNNMAIALTDLGTKVKLEGNIAQGVAYYKRALYYNWHYADAMYNLGVAYGEMLKFDMAIVFYELAFHFNPHC

SEQ ID NO: 179 - protein, 206 aa, Cucurbita moschata
QIGFNCCAQVLLRSVLAEKQELCFSVISLLWHKLITAPETQPSVESTSAQQGWRQVVDALCNVVSASPAKAATAIVLQAERQLQPWIAKDDDQGQKMWRINQRITKLIVELMRNHDTPESLVVLASALDLLLRATDGMLVDGEACTLPQLELLEATARAVKPVLEWGESGLSIADGLSNLLKCRLPATVRCLSHPSAHVRALSTSL

SEQ ID NO: 180 - protein, 172 aa, Cucurbita moschata
DTVGAGNTSELEEMDPPSALLCELRPYQKQALHWMIHLEKGKCMDEAATTLHPCWEAYRLIDERELVIYLNSFSGEATTEFPSTLQIARGGILADAMGLGKTIMTISLLLAHSERGGVSNSQLTCSSVEGDDGSMDQSLNPLKKAKITGFEKLQKRNTLASGGNLIICPMSL

SEQ ID NO: 181 - protein, 210 aa, Cucurbita moschata
IPGVHIGDLFFFRMELCVVGLHGQAQAGIDYVPASQSSNGEPIATSVIVSGGDEDDEDSGDTIIYTGHGGQDKFSKQCMHQKLEGGNLALERSMHYGIEVRVIRGMKYAGSVTSKIYVYDGLYRILECWFDVGKSGFGVYKFKLLRIDGQAEMGSSILKFAENLRSKPLSLRPSGYLSLDISMKKEAVPVLLFNDIDNDQEPLYYEYLVG

SEQ ID NO: 182 - protein, 231 aa, Cucumis sativus
RCKQAMGFCLHNNAAVSALAAQAAGAKKVLIVDWDVHHGNGTQEIFEQNKSVLYISLHRHEFGRFYPGTGAADEVGTMGAEGYCVNVPWSRSGVGDNDYIFAFKQVVLPIASAFAPDLTIISAGFDAARGDPLGMCDVTPTGYNLRSISSSATAVIKVLLGESPECDLDDHLPSSAGMKTVLDVLAIQKNFWPVLESSFSKLQSMLEIFATERRGKVKPCKQRRRAVVAPI

SEQ ID NO: 183 - protein, 167 aa, Cucurbita maxima
MGRKKIELKRIEDMCNRHVTFCKRRSGLIKKARELSVLCDVEVGLVIFTNRGRLYEFCSGDSLLNIIKRYQSHFEGRSESQNEVDTKENEESDETLMVSFGKLLQTIQSHVEEPDFKKLNVNDMVHLENQLEASLDKIKSQRVEAMMENSSWIDKMDMAIAMVDSQL

SEQ ID NO: 184 - protein, 198 aa, Cucurbita spp
RSDEEGKFAPSLETLEISRTKIVKSIPNYFGGEDEDGIPDLADIEENDDALATDAATLPLTYQIAHEPDDDNILRTRTYDVSITYDKYYQTPRVWLTGYDESRMLLQPEHVLEDVSQDHARKTVTIEDHPHLPGKHASVHPCRHGAVMKKIIDVLMSRGVEPEVHKYLFLFLKFVASVIPTIEYDYTMDVDLGGPSRR

SEQ ID NO: 185 - DNA, 312 bp, Arabidopsis thaliana
atgtctggtcgtggaaagggaggaaaaggcttgggtaaaggaggagccaagcgtcacaggaaggttctgagagacaacatccaaggaatcaccaagcctgccattcgaagattggctcgtagaggtggagtcaagcgtattagtggtctcatctacgaggagacacgtggcgtcctcaagatctttctcgagaacgtaattcgtgatgctgtcacttacaccgagcacgctaggaggaagactgtgaccgccatggatgttgtctacgctctcaagaggcaaggaaggactctctacggattcggcggttaa

SEQ ID NO: 186 - DNA, 2988 bp, Arabidopsis thaliana
atgagtgcccaaatggaagaaccagagactctcggcaaaagaaaagaatctgaaagttcaaaacttcgttctgatgaaactccgacgccagaaccaagaacgaagcgtagaagtcttaaacgtgcttgtgtacatgaagttgctgttcctaatgattacacaccaacgaaagaagagacgattcatgggacgcttgataatcctgtcttcaatggagacatggccaagacttatccttttaagcttgacccttttcaaagtgtatctgtagcttgtttagagagaaaagaatcgattttggtatctgctcatacttcagctggtaaaactgctgttgctgagtatgctattgcaatggcgtttagagataagcagagagttatttacacttctcctttgaaagctttgagtaatcagaagtatagagagttgcaacatgagtttaaagatgttggtttgatgactggtgatgttactctttcacctaatgctagttgtttggttatgactactgagatcttgagagctatgctttatagaggatctgaagtgttaaaggaggtcgcttgggttatttttgatgagattcattatatgaaggatagagaaagaggagttgtttgggaagagagtattattttcctgcctcctgctattaagatggtattcctttctgcgactatgtcgaatgctactgaatttgcggaatggatatgttatttgcacaagcagccatgtcatgttgtgtacacagattttaggccaacacctctgcagcattatgcttttcctatgggtgggggtggactgtaccttgtggttgatgataatgagcagtttcgggaggatagtttcgttaagatgcaggatactttccccaaaccgaaatctaatgatgggaaaaagagtgcgaatggcaaatctggtggtaggggtgctaaaggtggaggtggccctggtgattctgatgtttacaaaattgtaaagatgatcatggagagaaaatttgaaccagtcattatcttcagcttcagtagaagagagtgtgaacagcatgcattgtcaatgtcaaaactcgattttaatacagatgaagagaaagaagttgtggaacaggtgtttaataatgcaatgcagtgcttgaatgaagaggatagatccttacctgccattgaactgatgttgccactgctccaacgtggtattgctgtccatcattctggtcttcttcctgtcatcaaggaattagtggagcttctttttcaggaaggacttgtgaaagcgctttttgccacagaaacctttgctatgggtttgaatatgcccgccaaaactgtagtgtttactgctgttaagaagtgggatggtgacagccatcgttacattgggtctggtgaatatatccagatgagcggcagggctggacgtcgtggaaaggacgagcgtggcatctgcattattatgattgatgaacagatggagatgaatacactcagggacatgatgttgggaaaaccagcccctttgcttagtacttttaggctgagttactacacaattttgaatctattgagtcgtgccgaaggacaatttactgctgagcatgttataaggcactcgttccatcaattccagcatgaaaaggctttaccggatattgggaataaggtgtccaaacttgaagaggaagctgccattcttaacgcttctggagaggcggaggttgctgaataccataatctacaatttgacattgctaaacatgaaaagaaacttatgtcagaaataattaggcctgaaagggtgctttgttttcttgatactggtcggctggttaaaataagagaaggtggaacggattggggctggggagttgtcgttaatgttgtaaaaaattcttcagttggaactggttccgcctcttcacatggtggcggatatatagtggatactctacttcattgctctactggttttagtgaaaatggcgcaaagccaaagccatgtcctccccgtgctggggaaaagggtgaaatgcatgtggttcctgttcagctacccttaatttctgctttgagcagactaaggatatcagttccttctgatcttcggccagtggaagcaagacagagtatactacttgcattacaggagttgtcaagtcgcttccctctagggttcccaaaactccatccagtcaaggatatgaatattcaagacacagagatagtggatctggtcagccaaatcgaagaagttgagcagaagttacttgctcatccgatgcacaagtctgaagatgatcaacaaatcaagagtttccagaggaaagcggaggtgaattatgaaattcaacagctaaaatcgaaaatgcgtgattcccagctccaaaagtttcgagatgagcttaagaaccgatctcgggtattaaagaaacttggacacattgatgctgatggtgtcgtccaggtaaagggacgagctgcgtgcttgatagacacaggggatgaattgcttgtcactgaactgatgtttaatggtacttttaatgatctggatcatcaccaagtagcagcccttgcaagctgtttcattcctgttgataaatcaaacgaacaggtaaatttaaggaatgaacttaccaaaccattgcagcagctccaagatagtgcacggaaaatagcagagatacaacatgaatgcaaactggaaattgacgtggaagagtatgtggaatccaccatcaggcctttcctgatggatgttatctactcttggtcaaagggcgcaagctttgcagagattatacaaatgactgacatattcgaaggtagtatcatcagaagtgctagaagactcgacgagtttttgaaccagcttcgagctgcagcagaggcagttggtgaaagcagtttagagagcaagtttgcagctgctagcgagagcttgcgacgaggtattatgtttgcaaattcgctttacttgtaa

SEQ ID NO: 187 - DNA, 3591 bp, Arabidopsis thaliana
atggggtcagagggaaatatgaagaagtcggttgtgacacaagtaagcattggtggatttggggaatccactactgcaaaacaactcacagattaccttgaagatgaagtaggaattgtttggcgttgcagattaaaaacttcgtggactcctcctgggtcttatcctaattttgaaatcgcagacacttcaaatatccccagtattgatgaatataagaaagtggagcctcatgcctttgtccatttcgcagtttttgaatcagctggtcgtgccatggatgctgcagggcaatgcaacctcatcttggatggccagccgttaaaagtcagtttgggtcctaagaatccatattcccttaatcaaagaagaagaacgactgtaccttataagttggctggtattacacttgagattgggacattggtttctcgggatgatttttttgtttcttggagagctgaaggggttgatttcctggtggatccttttgacaacacgtgcaagttttgtttcagaaagagcactgccttctctttcaaggatgcagtgatgcatgctgtgatcaattgtgattataagttggagttattggtgagagatatacaaacagtcaggcagtataaaaccttgcatggctttgtgcttattttgcagctggcttcttcaccccgtgtctggtacagaactgctgatgatgatatttacgatactgtccctggcgatctcttggatgatgatgatccttggatccgtaccactgattttactcaagttggggcaattggtcgatgtcattcatatcgagtgctcatatctccgcggtatgaaaataaactgagaacagccttagattattttaggatgcggagggtgcaagaggaacgtgtgaggtggcctccccgtatccgtaatgagccttgttttggggagcctgtgtcagatcatttcttctgcattcatcacaaggaaggaatctcttttgagatcatgtttctagtaaattcggtattgcacaggggtgtctttaaccagtttcagttgactgagcgattctttgatcttctaagaaaccaacccaaggacgtcaatatagcttctctcaagcatctctgtacctataaacgaccagtttttgatgcgtacaagaggttgaagcttgttcaggaatggattcagaaaaatccaaagcttttagggagtcatgaacaatctgaggatatctctgagatcagaagactagtaattaccccaaccagagcctattgcctacccccagaagttgagctctccaacagggtactcaggagatacaaagctgttgctgaaagatttttgcgggtaactttcatggatgaaagtatgcagaccataaattcgaatgttctctcttactttgttgctcctattgtgaaggatttgacatcaagttctttctcccagaagacctacgtttttaaaagagtgaagagcatattaaccgatgggtttaaactatgtggtagaaaatacagttttctagcattctcagccaatcaactgagagaccgctctgcatggttctttgctgaagacgggaaaacacgtgtgtcagatataaaaacatggatggggaagttcaaagacaagaatgtggcaaaatgtgctgctaggatgggcctgtgcttctcctccacatatgccactgtagatgtcatgcctcacgaggttgacactgaggttccagatattgagagaaatgggtatgttttctctgacggaattggtacaatcacacctgacctcgctgacgaagtaatggagaaacttaagttggatgtgcactacagcccttgtgcttatcagatacgttacgcaggtttcaaaggggttgttgctcgttggccatcaaaaagtgatggaatcaggctagcccttcgagacagtatgaagaagttcttttccaaacatacgatcttggagatctgttcctggacgaggtttcaacctgggttcttaaatcggcagataattacccttctatccgtactaggtgttccggatgaaatattctgggatatgcaggaatccatgctctataaactgaaccgcatccttgatgatacagatgtggcatttgaagttctcacggcatcatgtgctgaacagggaaacactgcagctatcatgcttagtgcaggtttcaaaccaaaaaccgagccgcatctacgcgggatgttgtcttcagtcagaattgcacaactctggggtctcagagaaaaatctcgtatttttgttacttcaggaaggtggctaatgggttgcctagacgaagcagggatacttgaacatggccaatgctttattcaagtctctaaaccgtctatagaaaattgtttctccaaacatgggtctcgttttaaggagacaaagacagatctggaagtagttaaaggctatgtagccattgctaagaatccttgtcttcacccaggggatgtaaggattttagaagctgttgatgtaccccagctgcatcacatgtatgactgccttattttccctcagaaaggtgataggccgcatacaaacgaagcttctggcagtgaccttgacggggacctgtactttgtggcttgggatcagaaactcatccctcccaacaggaaaagctatccggccatgcattatgatgcagctgaagagaagagtttaggccgtgctgtcaaccaccaggacataatcgatttctttgcaagaaacttggcgaatgagcagttgggcacaatttgcaatgcacacgtcgttcatgctgatagaagtgagtatggagccatggacgaagaatgtttgctactggcagaactagctgccactgcagttgatttcccaaagacagggaaaattgtgtcaatgcccttccacctaaaaccaaaactctacccagatttcatgggaaaagaagactaccaaacttacaagtcgaacaaaatcttgggtcggctttacagacgggtaaaagaggtttatgatgaagatgcagaagcttcctcagaagaaagcacagacccaagtgccatcccttatgacgctgttcttgaaataccgggatttgaagatttgatccctgaggcatggggtcacaaatgtttgtacgacgggcaactcattggtcttcttgggcaatacaaggtgcagaaagaggaagagattgtgacgggtcacatctggtccatgcccaaatacacaagcaagaaacaaggcgaactgaaagaaagactgaagcattcttataattcccttaaaaaggagttcaggaaagtatttgaggaaacaatccctgaccatgaaaatctcagcgaggaggaaaaaaacatcttgtatgagaagaaggcttcagcttggtatcatgtaacttaccatcccgagtgggtgaagaagtctttagagctgcaagatccagatgagtccagtcatgcggcgatgctgagttttgcttggattgcagctgattatcttgcaagaatcaaaatccggtcacgggaaatgggaagtatcgactcagccaagcctgttgattctttggctaagtttcttgctcagcgtctctaa

SEQ ID NO: 188 - DNA, 2232 bp, Arabidopsis thaliana
atgtcagacgctctttctgcgattccggccgcagttcatcgcaatctctccgataaactctatgagaagcgcaaaaatgctgcgcttgagcttgagaatattgtgaagaatctaacttcttcgggtgatcatgacaagatctcgaaagtcattgagatgttgattaaggaatttgccaaatctcctcaagctaatcatcggaagggtggtctaattggcttagctgctgtaactgttggtttgtctacagaagctgctcaatatcttgagcaaatagtgccacctgtgattaattccttttctgatcaagatagccgagttcggtactatgcatgtgaagctctctataacattgcaaaggttgtgcgaggcgatttcattattttcttcaataagatatttgatgccttatgcaaactctcagcagattctgatgccaatgtccaaagtgctgctcatcttttggatcgccttgttaaggatattgtgacggaaagtgatcagttcagtattgaggaattcatacctcttttaaaagagcgaatgaacgttctcaacccttacgtccggcaatttctggttggatggatcactgttcttgatagtgttccagacattgacatgcttgggtttctgccagactttctcgatgggttattcaatatgttgagcgactctagtcatgaaatacgacagcaagctgattcagctctttcagagtttcttcaagagataaaaaattcaccatctgtagattatggtcgcatggctgaaatactggtgcagagggctgcttctcctgatgaattcactcgattaacagccatcacgtggataaacgagttcgtaaaacttgggggagaccagctcgtgcgttattatgctgacattcttggggctatcttgccttgcatatctgacaaagaagagaaaatcagggtggttgctcgtgaaaccaatgaagaacttcgttcaatccatgttgaaccctcagatggttttgatgttggcgcaattctctctgttgcaaggaggcagctatcaagtgagtttgaggctactcggattgaagcattgaattggatatcaacacttttaaacaagcatcgtactgaggtcttgtgcttcctgaatgacatatttgacacccttctaaaagcactatctgattcttctgatgacgtggtgctcttggttctggaggttcatgctggtgtagcaaaagatccacaacactttcgccagctcatcgtatttcttgtccacaatttccgagctgataattctcttttggaaaggcgcggtgcccttattgtccgaagaatgtgtgtacttttggatgccgaaagagtctaccgagagctctctacaattcttgagggagaagataatcttgactttgcttctaccatggttcaggcattgaatttgattttgcttacttccccggagttatcgaaactgagagaactattaaaaggttcactcgtcaatcgcgaagggaaagaacttttcgttgccttgtatacttcatggtgccattcacccatggcaattataagcctctgcttattagctcaggcttaccagcatgcgagtgtcgtgattcaatcattggtagaagaagacattaacgtcaaatttctagtacagcttgataaattgatccggcttctggaaactccaatctttacttaccttagattgcagcttctggaaccaggaaggtacacatggttgctgaaaacactttatggtcttcttatgttacttcctcagcaaagtgcggcgttcaagatacttaggacaagactcaaaactgtgccaacgtactcattcagtactggaaaccaaataggcagagcaacttcaggagttcctttctctcagtataagcatcaaaacgaggacggtgacttagaagacgataacatcaacagttctcaccaaggaatcaattttgctgtgcggctacaacagttcgaaaacgtacagaatctacatcgtggccaggcaaggactagagtgaactactcatatcactcttcctcttcttctacatcaaaggaggtgaggagatctgaagaacaacaacagcagcagcagcaacaacaacagcaacaacaacaacaacaacgaccaccaccttcttcgacatcatcatcagttgcagataacaatagacctccatcaagaacttcaagaaaaggccctggtcaattacagctttaa

SEQ ID NO: 189 - DNA, 2589 bp, Arabidopsis thaliana
atggctcagtttcttcgacgcttctcttcctctcccatggcgaacgaagacgaattccaatctccggtggaaccatcacagcagcaatctcaggactgtgtttcggagtcttatctgatagggtttgttatcgcgaacatagtagggttaaagtactattccggccgaatcaacggtcgagagatggtgggtctggttcgagaacccttgaacgtatatgacaataatgcaatcagagtactcaacacgcgatctgagcaagtgggtcacatcgagcgtacagtagcagccgttctcgcgccgatgattgattctcacacgatcgtcgtcgagggtattgtacccaatactcgttctaactccaataggtacagaatcccttgtcaaattcatgtatttgcaaagttagaagcgtcctctactgtgaaatcgacgatttctagaggtgggttagtattgatttcggagtcagatacatcgtttgggttatctgaggctgttgtggttaaggaacagatgggaaatggagataagaggagtgttgataagatttttaaacttgttgatgagaatgtgaagttaatggggaaattggtagcggctgagccacctagggaagtgataaagtctgaactttttgctcatcagaaggaaggattaggctggttactccatagagagaaatctggagaattgcctccgttttgggaggagaaagatggagaatttttgaatactttgacgaattaccgctcggataagcggcctgatcctttgcgtggaggggtgtttgctgatgatatggggttgggtaagacccttactttgctttccctgatagcttttgatagatatggcaatgcatccaccagtacgccaaccgaagagcctttggatggtgaaggagacaagattgaaaagaagggtaaaaagagaggaagaggcaagagcagtgaaagtgtaactcgaaagaagcttaaaactgatgatgttgttggcatgaatgtgtctcaaaagacaacgttgatcgtttgtccaccttctgtgatttcagcatggataacacagttagaggagcatactgtaccgggaatcttgaaggtgtatatgtatcatggtggcgaaaggacagacgatgttaatgagcttatgaagtatgacatagtgttgactacttacggcactttagctgttgaggaatcgtgggaagattctcctgtaaagaaaatggagtggctgagaataattcttgatgaggcacacaccattaagaatgcaaatgctcaacagagccgagtagtttgtaagttgaaggcttcccgcagatgggctgtcacaggaactcctattcagaatggttcatttgatttgtactctttgatggcctttctccggtttgagccattttcgattaagagttattggcaaagtttgatacaacgcccgcttggccaagggaataaaaagggtctttcacgtctgcaggttttaatggcgacaatttcgttaagaagaacaaaagaaaagagtttgattggtttaccgcctaagactgttgaaacttgttatgttgagctttctccggaagaacgtcagttatatgatcacatggaaggagaagcgaaaggtgttgtgcagaatcttataaataatggaagcttgatgcgcaactactcaacagttttgagtataatcttacggcttagacagctttgcgatgacatgtctctatgccctccagaattaagatcttttaccacttctacatctgtagaagatgtgactgataagccagagctactgcaaaagctggttgcagcattgcaagatggcgaagattttgactgtccaatctgcatttcgccaccaacaaacatcatcatcactcgatgtgcccacatcttttgcagggcttgtatccttcaaactcttcaaagaagtaaaccattgtgccctctttgccgtggctcccttacccaatctgatctctacaatgctccgcctcctcctccggattcttccaataccgatggagaagacgctaaatcttcaaccaaatcctcaaaggtctcagctttactatccctgctcatggcatcgagacaagaaaaccccaacacaaagtctgttgtgttctctcaattcaggaagatgctgcttttactagaaactccactaaaagctgcgggtttcaccatcttgcgcttggatggagcaatgactgtgaagaaacggacccaagtcattggagaatttgggaatccagagttaaccggacctgtggtgttgcttgcgagcctcaaggcctctggtactggcataaacctaactgcagcctcaagggtttacttgtttgacccgtggtggaaccctgcagttgaagaacaggccatggacaggattcataggatcgggcagaaacaagaggttaaaatgataaggatgattgcgagaaacagtatcgaagagagggtccttgagcttcagcagaagaagaagaatctagcaaacgaagcttttaaaagaaggcaaaagaaagatgaaagagaggttaacgttgaagacgtggttgctctcatgtctctctga

SEQ ID NO: 190 - DNA, 1767 bp, Arabidopsis thaliana
atggctgaggagaagaagaataagaagaaaaagagtgacgctaaggttgattctgaagaaaccggtgaagaattcatttccgagcacagttctatgaaggataaggaaaagaagaggaagaagaataagcgagagaataaggatggttttactggagaagatatggagataactgggcgtgaaagtgagaaactaggtgatgaggtttttatagttaagaagaagaagaagtcgaagaagccaataaggattgattctgaagctgttgatgctgtgaagaagaaatcgaaaaagagaagtaaggagacaaaggctgattccgaagctgaggatgatggtgtggagaagaaatccaaggagaaaagtaaggagacaaaggttgattctgaagctcatgatggtgtgaagaggaagaagaagaagagcaagaaagaatctggtggtgatgtgatagaaaatactgaaagctccaaagtatctgataagaaaaagggaaaaagaaagcgggatgatactgatttgggagctgaagaaaacatagacaaggaggtgaagaggaagaacaacaagaagaaaccaagtgtggattcagatgttgaagatatcaatttggactctacaaatgatggaaagaagaaaaggaagaaaaagaaacaaagtgaggattcagagactgaagaaaacggcttgaactctaccaaagacgcaaagaagagaaggaagaagaagaagaagaagaagcaaagtgaagtctctgaggctgaagaaaagtctgataaaagtgatgaagacttgaccaccccatctacatcaagtaaaagggtgaagttttctgaccaagtggagttttttcctagtgatgatgatgaaggaacggaagatgatgatgaagaagaagttaaggtggtgaggggtaagcggtttacaaaagaagaagatgagatggtaaagaatgctgtattagaatacattgataaccatgctttaggagatgaggggataaagatggttatggaatgcaaggcatacccacaacttaaaggctgttggaaagaaattacatctgctttaccttggaggacttataatagtgtgtatcatcgtgcacatactatatttgaagcaggatctcaggggatatggacgaaagaggatattgaactcgttatggagtttcaaaagacacacgggaatgattggaaaacacttgcagatgcaatgggtaagcacaggaagcatgtgaaagacgcttggaggagaggaagattggcaggtaagaagaaaggacattggatgagggaggagtatcaaaacctctttgaccttgtcaacaaagaccttagaatgaaagcattcaaagagaaacactcaaaacatggtatgctcaaagataacatcccttggatggctataagcgacgtacttgaaacacgggaccacgtgacttgctgccagaaatggtatgagcagttgatatcaccaatggtagcaaagggaatgtgggctaacgttgatgactataggctcttggaagagcttttgaaactggatgctgcttgtatcgacgatgtggattgggataatcttttggagaatcgagatggagaagcttgtagaaaacggtggaaccagatgatcattcatatcggcgtaccgaaatcgaaaacatttgcagaacaagttgagattttgtctgacaggtattgccctgacatagctgaggacagagaggattttgacaacagaccctatgatcctgaagattaa

SEQ ID NO: 191 - DNA, 891 bp, Arabidopsis thaliana
atggagaacggagaatctaaccaagaaaatctcaaatctctcaaccacgacgaatcgcttaagaagccatctgcttcctccgtcgttgtagataggttaaaacgtgatgaatggagcgaaggagctgtttcgactttactcgaagcttatgagtcaaaatgggttctcagaaacagagccaagcttaagggacaagactgggaagacgtggctaaacacgtgtcctcacgcgccactcacaccaagtcaccaaagactcagactcagtgcaagaacaagatcgagtccatgaagaaacggtaccgttctgagtccgctactgctgatggctcctcttggcctctttatcctcgtcttgatcatctcctacgtggaactcagcctcagcctcagcctcaagctgttctgcctctgaattgctctgttcctctgctcttacttgagccgccgttgcctgcggtggctcatccgccgcagatttcttacggatccaacggcgtcggcaagattcctaaggaagacggattcaagccggagaacaaaccggaaaaagatgcggagatggatacagacagtagtacgcctgtggttaaaacgaaggtgagagggaagaaagtgaagagaagatataaagaagagaaggaagagatcgccggaagtatacggtggttagcggaggtggtgatgagatcagagagagcaagaatggagacgatgaaagagatagagagaatgagagctgaagctgaagctaagagaggagaattggatttgaaacggacggagataatggcgaatactcagctagagattgctagaatctttgctgctgcagcttcttctggacagaacaaaggtgttgattcttcattaaggatcggaagaaattga

SEQ ID NO: 192 - DNA, 2010 bp, Arabidopsis thaliana
atgcaaggagttcctggatttaatactgttccaaatcctaaccattatgacaaatcaatagtgttagatattaaaccgttgcgaagtttgaaacctgtttttccaaatggtaatcaaggtccaccttttgttggttgtccaccttttggtccttcctcatctgagtattcttctttcttcccatttggagcacaacaaccaacgcatgatactccagatctcaaccaaactcagaacacgcctattccatcatttgttccacctcttcgatcgtatagaacacctactaaaacaaatggccccagcagctccagtggaactaaaagaggtgttggtcgacctaagggaactactagtgtgaagaaaaaagagaagaagactgtggccaatgagcctaacttagatgttcaggtagtgaaaaaattcagttcagattttgacagtgggatcagtgcagcagagcgagaagatggaaatgcgtacttagtaagtagtgtattgatgcgttttgatgcagttaggaggcggctcagccaagtagaattcacaaagtccgctacttctaaagcagcaggtactctgatgagcaatggggtgcggacaaacatgaagaagagagttgggacggttcctggaattgaggttggagatatcttcttttcccggatagagatgtgtttagtgggtcttcacatgcagactatggctggcattgactatataattagtaaggccggttcagatgaagagtctttagcaactagcattgtttcatctggacgttatgaaggtgaagctcaggatcctgagtcattaatttacagtggacaaggcggcaatgcagacaagaacagacaagcatctgatcagaagcttgaaaggggtaatctagcattagagaatagcttgaggaagggaaatggagtaagagtcgtaagaggggaggaggatgcagcttcgaaaacaggaaagatctatatctatgatgggctttattcgatctcagagtcatgggtagagaaagggaaatctggttgcaacacctttaaatataaattggtgagacaacctggtcaaccacctgcgtttggcttttggaaatctgttcagaagtggaaggaaggtttgactacaagaccaggcctgatccttccagatctcacctcaggagctgaaagtaaacctgtttcacttgtgaatgatgttgatgaggataaagggcctgcttattttacctatacctcctctctgaaatactcagagacctttaaactaactcagcctgtaattggttgttcctgcagtggttcatgttcaccaggaaatcataactgctcttgtatcagaaaaaatgatggtgatctcccttaccttaatggggttatactcgtttcccggaggcctgtgatatatgaatgtggcccaacgtgtccttgtcatgccagttgcaaaaacagagtgattcagacaggactgaaatcccgcctggaagtgtttaagacaagaaaccgcggttggggtttacgttcgtgggattccttacgtgctggttctttcatatgtgaatatgctggtgaagtcaaagacaatggcaaccttagaggaaaccaagaagaggatgcgtatgtctttgacacatcgcgtgtttttaactcgtttaagtggaattatgagcctgagcttgtagatgaagacccttcaactgaagttcccgaagagtttaatctcccatcaccactcctaatcagtgccaagaaatttggcaatgtagctcggttcatgaaccatagttgctctcctaacgttttttggcagccagttattcgtgaaggaaacggtgaatcagttatccacattgctttctttgccatgcgtcatatccctcctatggcagaattgacatatgattatgggatttctcctacatccgaggccagagatgagagccttttacatggacagaggacatgtctctgtggatctgagcaatgtcgtggttcattcggatga

SEQ ID NO: 193 - DNA, 5121 bp, Arabidopsis thaliana
atgaatgttcaggctcacatgtctggtcaacggtctgggcaggttccaaaccaagggacagtgccgcagaataatggaaactctcaaatgcagaatttagttggtagtaatggtgctgctactgctgttactggtgctggtgctgctactggttctggtactggtgtaaggccttcacgtaacatcgttggtgccatggatcatgatattatgaaacttcgacagtacatgcaaactcttgtgtttaacatgttacagcaacggcaaccatctccagctgatgctgcatcaaaggcaaagtatatggatgttgctagacgtttagaagaagggctgtttaagatggctgtcacaaaggaggattacatgaaccggtcaacccttgaatctcgtattacaagcctaataaaaggaagacagataaataactacaatcagcgacatgctaattcttcttcagttggaacgatgatacctactccaggattatcacagactgcgggtaatcctaatttgatggttacatcctctgttgatgctactatagttggcaacaccaacatcacaagcactgctttgaacactggaaaccctctaattgctggtggcatgcatggaggtaatatgtctaatggatatcagcactcgtcgagaaacttttctcttggttctggagggagcatgacatccatgggtgctcaaagaagtacagcccaaatgattcctacacctggcttcgttaacagtgttactaacaacaacagtggtggattttctgctgagcccacaattgttcctcagtctcagcaacaacaacaaaggcaacatactggtggtcaaaacagtcacatgttgtccaaccatatggctgctggcgttagacccgacatgcaatcaaagccgtcgggtgcggccaacagctctgtaaatggtgatgttggagcgaacgaaaaaattgtagactcaggttcatcttacaccaatgcgtccaaaaaattacagcagggtaacttctctcttctttccttctgtccggatgatctcatttcaggtcagcatattgaaagcacgtttcatatttcaggggaaggttatagcacaacaaatcctgaccccttcgatggagctataacatcggctgggacagggacaaaggctcataatatcaatacagcaagtttccagcctgtgtccagagttaactcttctctgtcacatcaacaacaatttcagcaaccgcctaatcgatttcagcaacaaccaaatcagattcaacagcagcagcagcaatttctcaatcagaggaaattgaagcagcagactccgcagcaacatagattaataagcaatgatggcttggggaaaactcaagtggattcagacatggttacgaaggtgaaatgtgaacctggaatggagaacaagagtcaggctccacagtcccaagcatctgaacgattccagctttctcagctccagaatcaatatcagaactctggagaagactgccaagcagacgctcagcttctcccagtcgaaagtcagagtgatatatgtacatcactcccccaaaatagccagcagattcagcaaatgatgcacccgcagaatataggttctgattctagtaacagttttagcaatcttgctgttggagtaaaatcagaatccagtccacagggtcaatggccttccaagtctcaggaaaatactctaatgtctaatgctatttcaagtggaaagcacattcaggaggatttccgtcaaagaattaccggaatggatgaagctcaacctaataatttgactgaagggtctgttattggtcaaaatcatacttctactatatcggaatcccataatctgcaaaattctattggtaccacatgtagatatggaaacgtaagtcacgatcccaagttcaaaaatcaacaaagatggctactgtttctacgtcatgcacggagttgcaaaccgccaggagggagatgccaagatcaaaattgcgtaacagttcagaaactatggagtcacatggacaattgtgctgatcctcagtgtttgtatccccgctgtcgtcacacaaaggcattgattggccactataaaaactgcaaggatcctcggtgccccgtctgtgtgccagtgaagacttatcagcaacaagctaatgttcgtgccctggcccgtttaaaaaacgaaagcagtgctgtgggctcagtgaatagatctgtagtatcaaatgattcactaagcgctaatgctggagcggtttctggtacccctcgttgtgctgatactttagataatttgcaaccttcattaaagcggttgaaggtggagcaatcttttcaaccagtggtccctaagactgaaagttgtaaaagctccattgtttctacaacagaggcagacttatctcaggatgctgaaagaaaggatcataggccattgaagtcagagaccatggaagtgaaagtggaaattcctgataattctgttcaagcaggattcggcatcaaagaaacgaaaagtgaaccttttgaaaatgttcccaagcctaagcctgtcagtgaaccaggtaaacatggtttatctggtgactcgccaaagcaagaaaacatcaaaatgaagaaagagcctggatggccgaagaaagagcctggatgtccaaagaaagaagaactggtggagtctcctgaacttacctcaaaatctagaaaaccaaagataaagggtgtttctttaactgaattgtttactccggaacaagtgagagaacatatccgtggtcttcgtcagtgggttggccagagtaaagccaaagcagaaaagaatcaggcaatggagaattcaatgagtgagaattcctgccagttatgtgcggtggagaagcttacatttgagccaccacctatttattgtactccttgtggtgctcgtatcaaaaggaatgcgatgtactatactgttggaggtggtgaaactcgtcattacttttgtattccctgttataatgaatcccgaggagacactattctcgctgaagggacttccatgccaaaggcaaaactcgagaaaaagaaaaacgatgaagagattgaagaatcgtgggtccaatgtgataaatgtcaggcctggcagcatcaaatatgtgctctatttaatgggcggaggaatgatggggggcaagctgagtatacctgcccatattgctatgtaattgatgtggagcaaaatgagagaaagcctttacttcagagtgctgttcttggagcgaaagatctgccaagaacaattctcagtgaccatatagagcagcggttgtttaaaaggctgaagcaggaaaggactgagagagccagggttcaaggaacaagttatgatgagattccaactgttgaatcccttgtggttagagttgtttcatctgttgacaagaagctagaagttaaatctcgatttcttgaaatttttcgggaggataattttccgacagaatttccatacaagtccaaggtggttctgctgttccagaagatagaaggtgtagaagtatgcttgtttgggatgtatgtccaagaatttggatccgaatgttcaaatcccaatcaacgccgtgtttatctctcgtatttggattctgtgaagtactttagacctgatatcaagtctgctaatggggaggctctgcgcactttcgtttaccacgaaattcttattggttatctggaatactgcaaattgcgtggtttcacgagctgctacatatgggcttgtccaccactgaagggtgaggattatatcctatattgccatccagaaattcagaaaacaccaaagtctgataaactacgggaatggtacttagcaatgttgagaaaagctgcaaaggaaggaattgttgcggaaactacaaatctatatgaccattttttcttgcaaactggtgaatgtagagctaaggttacagcagctagactcccgtacttcgatggtgactactggccaggtgcagcagaggatatcatatcccaaatgagtcaagaagatgatggtagaaagggaaataaaaaaggaatactcaagaaacccattacaaagagggctcttaaagcatctggccagtcggatttctctgggaatgcttccaaagacctgctactaatgcataaacttggtgagaccattcatccaatgaaggaggattttatcatggttcacttgcagcatagttgcacacattgctgtacgctgatggtaactggaaatcgttgggtttgcagccaatgcaaagatttccagttatgtgatggatgttatgaggctgagcagaaacgagaagacagagaaagacatcctgttaatcagaaagataaacataatatttttcctgttgagatcgccgatattcctacggatactaaggacagagatgagatacttgaaagtgaattctttgatacaaggcaagcattcctgagtctatgtcaagggaaccattatcagtatgatacactgaggcgggcaaaacattcttccatgatggtgctttatcatctgcataatcctactgctcctgcctttgtgacaacatgtaacgtatgtcacctcgatattgaaagtggtctaggctggcgctgtgaagtttgcccagactatgatgtgtgcaatgcttgttacaagaaagagggttgtattaatcatcctcataagttaacaactcatccatctctagctgatcaaaacgctcagaataaagaagctaggcaattgcgagtcttgcagctcaggaaaatgctcgatcttctggtgcatgcgtcgcaatgccgttctccagtttgtctatatcccaactgccgcaaagtgaaggggctattccgacatggtctccgctgcaaagtacgtgcttcaggaggttgtgttctatgcaagaaaatgtggtatctgttgcaactccacgctcgggcctgcaaggaatccgagtgtgatgtacctcgatgcggggacctaaaggaacatctgagaaggttacaacagcaatcagattctaggcggagagctgccgtcatggagatgatgagacagagagctgcagaagtcgctggaacctcgggttga

SEQ ID NO: 194 - DNA, 2748 bp, Arabidopsis thaliana
atgccgtctgatataatggaacagagaggtgtttcaacaccttcccactttcatgaagatattcatattacttcagagaggcaatttgggtttatgaaaacagacatgatgcctgaaaaccaaggtggtcgtgatagactttcaagtatgccaaagagttcctggacatctgaaagttaccagctgaagccacaatctagtttttctgggtcgcacccctctggtagccctaacgcaagaaacactacaaatggtagtcagtgggaaagcagtttattttccagctcaatgtctgatttatttagtagaaagctgcggctacagggaagtgatatgctatccactatgtctgcaaacacagttgttacccaccgtgaagaagaaccgtctgaatctttggaagagattgaggcacaaactattggaaatcttctcccagatgaagatgatctttttgcagaagtgacaggtgaggttgggcgtaaatctcgtgctaatacaggagatgagttggatgagtttgacctcttcagcagtgttggtggcatggaactagatggagatattttttcttctgtgagtcatagaaatggtgagagaggtggcaataattctgttggcgagcttaaccgtggggaaattccatccagaacacttttggtcggaaatatcagtagcaatgttgaagactatgagctgaaggtcctttttgagcaatttggagacatccaggctcttcatacagcttgcaaaaatcgtggctttatcatggtatcgtactgtgatataagggctgctcagaatgcggcgagagcactccagaataagctgttaagaggaacaaaacttgacattcgttattctatctctaaggaaaatccttcacaaaaagatacaagtaaaggagccttgttggttaataatctcgattcttctatttcgaatcaagagctgaatcgactggtcaaatcgtatggagaggtcaaagagattcgtaggaccatgcatgataactcacagatatacatagagttctttgacgttcgagctgcagcagctgctcttggtggactaaatggacttgaggttgctgggaagaagcttcaacttgtgccgacctatccagagggtacaagatacacgtcgcagtgtgctgcaaatgatactgaagggtgtctacctaaaacgtcttatagtaatacatcatcgggacacataggtagacatttcccaggaatgatttcttcaacctccagtgatggtggatctatgcgggttatacataattctattggatcacctgtgaattccttcattgaacgacatcgtagtctcagcattcctattggattcccaccttcggcaaacggcatctcagcaagtaagcctgtaggacttcaggagcatggccaccattttgataattcaaatatggggatccaaagcatgccaaatctccatcctcattctttttcggagtacgtcgacaactttgcaaatggtagtccatatacgtcctctgcattttctgaaatggtcagtgatggctcaaaagcaaatgaaggctttatgatacataatgttcgtggagtggaaggctttagtggaggcggtataggatctcccatgcatcaaagctctcgccgccctattaatttatggagcaactctaacactcagcaacaaaatccgtcaagtggcatgatgtggcctaactcgccatctcacatcaacagcattcctactcagcgcccacctgttactgtattctctagagcacctcctataatggtgaatatggcatcttcccctgtgcaccaccacattggatctgcgccggtattaaattctcctttctgggacagaagacaagcctatgtagctgaatctctagaatcatctggcttccacataggttctcatggtagcatggggattcctggctcttcaccatcacatccaatggacattggttctcataagactttctctgttggtgggaatcgcatggatgtaaattcccaaaatgctgtcctgcgatctcctcaacagttatctcatctctttcctggaaggagtccaatgggttcgatgccagggtcatttgactcgccaaatgaacgatacaggaatctctctcaccgaagaagcgaatctagctctagcaatgctgacaaaaaactgtatgagcttgacgttgaccgtatattacgtggggaggacaggaggacaacattgatgattaaaaacattcctaacaagtacacttcgaagatgcttctatctgctattgacgagcattgtaaaggaacttatgatttcctttatttgccaattgacttcaagaacaaatgcaatgtgggatatgctttcatcaatcttattgaacctgaaaagattgtcccattttttaaggcatttaatggcaaaaagtgggaaaagttcaatagcgagaaggtggcaacgcttacgtatgctcgtatccaagggaaaacagctcttattgcccatttccagaactcaagcttaatgaacgaagacaaacgttgccgacctattctcttccacactgatggtccaaatgctggtgatcaggaaccatttccaatgggaagcaacatacggtcaagaccaggcaagccacgaagcagtagcattgacaactacaacagctttagcatctcttccgtttctgaaaaccgagaagaaactcctaatggaactgatccgttcttgaaggagaactaa

SEQ ID NO: 195 - DNA, 411 bp, Arabidopsis thaliana
atggctcgtaccaagcaaaccgcaaggaaatccaccggaggaaaagccccaaggaaacaactcgcaacaaaggcggcgaggaaatcagctccggcgaccggaggagtaaagaagccacacagattccgtcctggaactgttgccctaagagaaatcaggaagtatcagaagagcactgagcttctgatccgcaagcttccgttccagcgtttggttcgtgagatcgctcaggatttcaaaacagatctgcgtttccagagcagcgccgtcgcagcacttcaggaagcggctgaagcatacctcgttggattgtttgaagacaccaatctttgcgcgattcatgctaagagagtcactatcatgcctaaggatattcaattggcgaggagaattagaggcgagagggcttaa

SEQ ID NO: 196 - DNA, 3633 bp, Arabidopsis thaliana
atgcatcccaagcgatcaagtcaaggagatggttcagttactaagccagttagaaccagtgataggcttaggaggaggcccaaattgcatggtcgctcatacttgtactactcttcaccaaacatgttacataatcggaaaagaaacacaaagacaagaacggcagcctctcagatcgcaaagatgctgcacaaaggaaaccgtccagcgagggcatcaaatgccgcgccaattgcatctgatctccggcgttccacgaggaagagaagaatttctgtaaacctggaggactatacagacagttctggagcggaggatgaggatatgatgagtccagcatatcgaactttgaggaggagagttcataaaaacttctcaacttcaaaaagtagaaaggacatggatgctgaattggcaccacgtcgtgagggtctccgtcctcgtcgttcaacaacaattgctaataaacgactgaaaacagaatctggcgctgaccaagatacatcagaagagaaagatggccaagatgaaactgagaatgggaatgaattagatgatgcggatgatggtgaaaatgaggttgaggctgaagacgagggtaatggagaagatgaaggcgatggcgaagatgagggagaagaagatggtgatgatgatgaagagggtgatgaagaacaagagggaaggaagagatatgatctgcgaaaccgtgctgaagtccggagaatgcctacgggagaaatcaacaagcaacaacaacctagatctcctcggagagtattgcatcagggcatgggcaccagggttggaagagatggtaggagaggtgggtctcggcctcacaagcgccatcgctttacaagaacagatgattcagatgattctcttcttgtggacgagttggaccagggccctgcaattccctgggctcgaggtggaaacagatctggagcaccttggctatttgggggtttggacacgtatgggtcaagttcattggggttgaacgttggagcttctggttggggtcaccagagtgatggtttggctgcattaacttctggtgttcagactgctggcccaagctctaaaggaggtgcagatatccagccactgcagattaatgaggatataaattttgatgacattggtgggctgtccgaatacattaatgatttgaaggaaatggttttctttccgttgctgtatccagagttctttgcaagttacagcattactcctcccagaggtgtactgctgtgtggtcctccaggcactggtaaaacactgattgctcgagcattagcatgtgctgcttcaaaagctggacagaaagttagcttttatatgcggaagggtgctgatgttcttagtaagtgggttggcgaggctgagagacagctaaagctactctttgaggaggctcagcgaaaccagccttccataatcttttttgatgaaattgatggtcttgctcctgtaagatctagcaagcaggaacaaatacataattctattgtttcaactttactggcgctgatggatggcctcgattctcgtggtcaagttgttctcattggagcaacaaacagggtagatgcaatagacggagctttacgccgccctggcagattcgatcgggagtttaatttttccttaccaggttgcgaagcacgagccgaaatattggatattcacactcgtaaatggaagcacccacctactagggagctgaaagaggaactggcagctacttgtgtagggtattgtggtgctgatctaaaagctttgtgcactgaagctgcgattcgtgcttttcgtgagaaatatccacaagtttataccagtgatgataaatacgccatagatgttgggttggttaatgttgaaaagagccactttgtagaggcaatgtcagctattactcctgctgcccatagagggtctgttgtgcaatccagaccactctctccggttgtgttgccatgtttacatcgacacctccttgaatccatgagtttaatatcagatatttttccctcgtcagccacgtcatcggagttgacgaagctgtcaatacttacatttggatctgcaattcctcttgtttatcgacctcgacttttgctgcttggtggtgaaggagttggactggatcatcttgggcctgcaattttacatgagctagaaaagttccctattcattctctgggacttccatctctcctttcggatcctggtgcaaagaccccagaagaagcgttagtacatatatttagtgaagctagaagaacaacaccttcaatactttacataccaatgttcaataattggtgggaaaatgctcatgaacagcttagggctgtatttctgactttgttagaagaattgccatcaaatctacccatattattacttgctacatcttatggtgaattgtctgacatggaagagcagtcagtatttgacaatcgatctgtctatactgtggacaaaccatcaagtgaagacaggtctttgttctttgaccgtttgattgaagctgctctctcagtcatttctggcttaaatggcaaacctgatggaccacaaccccttccagaacttcccaaggttccaaaagaacctactggtccaaaacccgcagaagtaaaagccaaggtggaagcagagcagcatgcccttcggcgattgcgtatgtgtctcagagatgtttgcaatagaatactatatgataaaagattcagcgcattccactttccagttactgacgaggatgctccaaactatcgctcaataattcaaattccaatggatacggctactctgctgcagcgtgttgatactgggcagtatctgacatgtacaccgtttttgcaagatgtggatctcattgtgagaaatgccaaggcttacaatggagatgattacgctggagcgagaattgtcagtagagcctatgagcttcgagatgtagtgcatgggatgctgtcacagatggacccagcactgctaacatattgtgataagatcgcagctgaaggtggtccttcactgataccagatgatctgagtggatcaatcctcggtttagctcctgttgtgcagatgggaactgttactagaaccagtgccagacttcgaaatgtgcagccagaggttaatttagatcgagattatgaaggtcttaaaaagcccaagaaaactactgatgctgtcagtatagattcagctgcagacaaatcacagaaccaagattcaggccaagaaatgccatctccggatgcggccaacccacagtcagcagctccttctccaacagatggtgatagagaagaccaaagcgagccaccaagtaaagaggcatctgcagaagatatgagtggtgattcttgcaagggtcctgcggccaagtcggataaagaaatttcaagccgaacagaatctgtaaagggagtattcatggaacgtactgacaactacagcattccgcagatggagaggctttacactcgaatcatgaagggtgttcttgagactctggacaaagggcttcgtgatgatgataataatcctaagcattcaattttgagatttttgtcggaattcgcacagcatcaggcgaatttctga

SEQ ID NO: 197 - DNA, 1602 bp, Arabidopsis thaliana
atgaagagagatcatcatcatcatcatcatcaagataagaagactatgatgatgaatgaagaagacgacggtaacggcatggatgagcttctagctgttcttggttacaaggttaggtcatccgaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccactacagcgacggctgagtcaactcggcatgttgtcctggttgactcgcaggagaacggtgtgcgtctcgttcacgcgcttttggcttgcgctgaagctgttcagaaagagaatctgactgtagcggaagctctggtgaagcaaatcggattcttagccgtttctcaaatcggagcgatgagaaaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattag

SEQ ID NO: 198 - DNA, 528 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 199 - DNA, 4488 bp, Arabidopsis thaliana
atggcagacgaggaagaaggagaaaacagcaacaaactaatgcttgttgctctcactgcaacaatgactaagttactcgatgctaggctggaagctttcaggcaagagcatatcaattctgacccagatagagatcgaactagaagagagcctagagatcctgtagacgatagagacacaatgagttactatagtcaatcctctagacagaccaaccatagaaggaggaggcatgacagagaagaaagagttctacctagagatgatcttgccggcttgaagatacgtattccttctttcaaaggaaccaacgaccctgatgagtatctagaatgggaaaagaagattgagctcgtgttcaattgccaacaatatactgaagaaagcaaagtgaaagtggcaccaaccgaatttcagaattacgccttgagttggtgggatcaattggttaccacaaggagacgtgctggagactatccaattgagtcctggactcaaatgaagaccataatgaggaagagattcgtgccaagtcactactacagagagctacacaacagattgagaaatcttgtccaaggaaacaaatccgtagaggagtactacaaagagatggaaaccttgatgttaagagctgatattcaggaggataatgaagccataatgtctaggttcatgggaggtctaaacagagatatcatagacagattggaggttcagcactatgtggagttagaggagctactgcacaaagcaatcatgtttgaaaaacagctgaagagaaggagctctaagcctagttttggttcaggaaagcctagctaccacaaggatgaacgatcaggatttcagaaagattataagcctttcatcaaaccaaaagttgaggatcaagatcagaaaggaaagggcaaagctgttatgacaagaactagagacatcaagggctttaagtgtcagggacatggtcattatgctagtgagtgttcaaacaagaggatcatgataatcaaagacactggtgagatagagtcagaggatgagcaactagaagagagttcatcaacagaagactatgaagcaccatcaaaaggagagctattggttacaatgaaagctttgagtgtgatagccaaaacggatgaacaagagcagcgagagaacctgtttcattcaagttgtatggtcaatgacaaggtctgtagcttgatcatagatggcggaagttgcaccaacgttgctagtgaaaccatggtggagaagcttggtctaaaagttatgaagcatccaaggccatacaagttgcaatggttgaatgaggatggagagatgagcgtggacagacaagtgaaggtaccattatctattggcaagtatgaggacgaaattttgtgtgacatactgcctatggaagctagtcacatactacttggaagaccatggcaatcggaccgtaaggattatactgatgtgtttccagaggagaatccagtaggcttaccacccattagaggcattgagcaccaaattgactttgttccaggagcgtctttgccaaacagaccggcttataggaccaatcccgtggagactaaggagctagaaaagcaagtgactgagctgatggagagaggccatattcgtgagagtatgagtccctgtgcagtacctgtgttgcttgtacctaagaaggatggaagctggaggatgtgtgttgattgcagagccatcaacaatataacagtgaagtatcgccatcctatacctagattagatgatatgttagacgaattgcatggttctagcatcttttctaaggttgatttaaaaagtgggtatcatcaaattaggatgaaagaaggcgatgaatggaaaactgcatttaaaactatacaaggtttatatgaatggttagtgatgccattcgggctgacaaatgcacctagtacattcatgagactgatgaatcatgttcttagagcttttataggacgttttgttattgtttattttgatgacatcctagtttacagcaagagtctagaagaacatgttgaacatttgaaaatggttttagaagtacttaggaaggaaaagctttatgccaatcttaagaaatgtacttttggaacagataaccttgtcttcttaggttttgttgtgagtacagatggagttaaagttgacgaagagaaggtgaaggcaattcgagaatggccaagtcctaaatctgtaggggaagtgaggagcttccatggacttgctggtttctataggaggtttgtgaaggactttagcactctagcagctccactgaccgaagttattaagaaaaatgttggattcaagtgggaacaagctcaagaagatgctttccaggccctaaaagagaagcttactcatgcccctgttttatcacttcctgattttcttaaaacttttgaaattgaatgtgatgcctccggggtaggaattggtgttgtcttaatgcaggataagaagccaatagcttatttcagtgaaaagcttggaggagctactctcaactatcctacctatgacaaagaactttatgctttagtaagggcattacaaacggggcaacattacctctggcctaaggagtttgtcattcacacagaccatgagtccttgaagcatcttaaaggacaacagaaactcaacaagaggcatgcaaggtgggttgaattcattgagacatttccttatgtcatcaaatataagaaaggtaaggacaatgtagttgctgatgcattgtcaaggaggtatgttcttctctcatctcttgatgctaagttacttggttttgagcatataaaatctctttatgcaaatgattctgattttgaaaagatatattcatcttgtgaaaagtttgcatttggaaaatattatagacatgacgggttcttgttttatgataaccgtttgtgtattcctaattcgtctttgagagagctgtttataagggaagcacatggtggaggcttaatgggacactttggagtctcaaaaactattaaagtaatgcaagatcactttcactggccgcatatgaaaagagacgtggagagaatatgtgaaaggtgtcccacatgtaaacaagctaaggctaagtcacaaccccacggtttgtatactcctcttcctattccttcgcatccttggaatgatatttctatggactttgtagtaggtttgccaaggaccaggacaggtaaggactcgatttttgtggttgttgatagattttctaaaatggcacatttcatcccttgtcataaaactgatgatgccatacatatagccaatctgttctttagggaagttgttcgtttgcatggcatgcctaagaccatagtatcagatagagacactaagtttcttagttatttttggaaaactctttggtctaagctaggaactaagttgttgttttctactacttgtcatccacaaactgatgggcaaactgaggtcgttaataggacattgtctacactcttgcgtgcattgattaaaaagaatctaaagacttgggaggactgtctacctcatgttgaatttgcatataatcactctatgcattctgcctctaaattttcgccttttcaaatcgtttatgggttcaatcctactactcctttggatttaatgcctttgcctttgagtgaaagagtcagtctagatggaaagaagaaggcagaattggtgcaacagattcatgagcaggccaagaagaacattgaagagaaaacaaaacagtatgctaagcacgccaacaagagtagaaaggaagtcatcttcaacgagggagacttggtttggattcatctccgaaaagaacgttttcctaaagagagaaagtccaaacttatgtcgaggatagacggaccctttaaagtgctcaagaggatcaacaacaatgcctactctttggatttgcaaggtaagtataatgtgagtaatagttttaatgttgctgacctttttccttttattgcagacaacacagatttgaggtcaaatccttttcaactgggagaggatgatgtgataatgacaagcttggatcatggagctgatgagataatgacaagcttggatcatggagctgatgagataatgacaagcttggatcatggagatgatgtgataatgacaagcttggatcatggagctaaggagcagtttgaaggagggaaagttatcaaccactcgatcaagcatgctgttgaagatttgagggagcttgaatctaatgactcgatggactactcgacccaacatgaagatgaactgcttggagctacaaaaaaggaagcaatgcatgttcttaatggtccaatgacaagatcgaagactagactactaaatcaagatatcactacacttctacaacacattgagggcagtcttaaacaagatgcttgtcaaaccacgttggttgtgattcaagcggtttaa

SEQ ID NO: 200 - DNA, 3879 bp, Arabidopsis thaliana
atggatgctgatgcgatggaaactgagaccactgatcaagtctctgcttctcctctacattttgccagaagttatcaggtagaggcacttgagaaagctatcaagcagaacactattgtcttcttggagactggttctggcaagacccttattgctattatgcttcttcgtagctatgcctaccttttccgcaagccttcaccatgcttctgtgtcttcttggttcctcaagtggttcttgtcactcagcaagcagaagccctgaagatgcatactgatctaaaagttggtatgtattggggagacatgggggtggacttttgggattcttcaacatggaaacaagaagttgataaatatgaggttctggtgatgacccctgccattttgctcgacgcgttgaggcatagttttctgagcttgagcatgatcaaggttctaatagttgatgagtgtcatcatgcagggggaaagcacccttatgcttgtatcatgagggagttctatcataaggagttaaattctggaacttccaatgttccacggatatttgggatgactgcttcacttgtctatacctgtgagaatgagtctgtgctggctgggtttgtccccttttctacaccaagcttcaagtattaccagcacataaaaataccaagtcccaaacgagcaagcttggtagagaagctagaaagactaacgataaagcatcgcttatcccttggaaccttggatctcaactcctctactgttgattctgtagagaagagactgttgaggataagttcaactctaacatattgtttggatgatctcggaattttgctggcccagaaggctgctcagtcattgtcagccagtcagaatgactctttcttgtggggcgaactaaatatgtttagcgtggccttggtaaaaaaattctgctctgatgcttcacaggagtttttggctgagatacctcaaggtcttaattggagtgttgcaaacataaatggaaatgcggaggcaggtctcctaactttaaaaactgtctgcctcattgagactcttcttggttatagctccttggagaacatacggtgcatcatttttgtggatagggtgataacagccatcgttctggaatcccttttggctgagattcttccaaactgtaataactggaaaaccaagtacgttgcaggaaataactctggtctgcaaaatcaaactcggaagaagcaaaatgaaattgtggaagacttccggagaggcttggttaacatcattgtagcaacatctattctagaggagggtctagatgttcaaagttgcaacctggttatcagatttgaccctgcatccaacatttgcagtttcatacagtctcgtgggcgtgctagaatgcaaaattcagattatttgatgatggtggaaagaatgcgcgaagagtctttggatcattctcttgttccctgtccacctcttccagatgattcagatgaaccactcttccgtgtcgaaagtactggagcaactgtaactcttagctcaagcgtcagcttaatatatcattactgctcaaggcttccttcagatgagtacttcaaaccagcccctagatttgatgtaaacaaggatcaggggagttgcaccctttaccttcctaagagttgcccagtaaaagaagttaaagctgaagcaaataataaagtgttaaaacaagctgtctgtcttaaagcttgcattcaactgcacaaagttggagctctaagtgatcatcttgtgcctgacatggttgtggcggaaactgtctcacaaaaactcggcaccagagttgtgcttgaagatgacattgggaacacaagcttccggttggaagatcataggggtacaatagctgtgacattgagttatgtgggagcttttcaccttacacaagaagaggtccttttctgtagaagatttcagataactctattccgagttcttttagatcacagtgtggaaaatttgatggaggcattgaatggattgcatctcagagatggggtggcacttgattatctactagttccatccactcattcacatgaaacatctcttattgattgggaagtgatcagatccgtgaatctaacttctcatgaggttttggaaaaacacgaaaattgttctaccaacggtgcttctcgcattctacacacaaaagacggcttgttttgtacttgtgtcgtacaaaatgcattggtttacacaccacataatggatacgtctactgcacaaaaggtgttctcaacaatctaaacggaaattcattattgaccaagagaaattctggcgatcagacttacattgagtactacgaggaaaggcatgggattcaattaaattttgtggatgaacctcttctaaatggaagacacattttcacgttgcatagttatcttcacatggccaagaagaagaaggagaaagagcatgacagggaatttgttgaactacctcctgagctttgtcatgtcattttgtccccaatatcagttgatatgatctattcatatacttttatcccatctgttatgcaacgcattgaatctttgcttatagcatacaacctgaagaaaagcatcccaaaagtcaatattccaaccattaaggttttggaagctattacgacaaagaagtgcgaagatcagttccacttggaatcactagaaactcttggtgactcttttctgaaatatgctgtttgtcagcaactattccaacactgtcatactcaccatgagggtcttcttagcacgaagaaagatggaatgatttcaaatgtcatgctctgccaatttggatgtcagcagaaacttcagggatttatccgcgatgagtgttttgaacccaaaggttggatggttccaggtcaatcatctgcagcttattcacttgtaaacgatactctacccgagtctagaaacatatacgttgctagtaggaggaatctgaaacgcaagagtgtggccgatgttgtagaatcattaattggagcatatctcagcgagggaggtgaacttgcagctttgatgttcatgaattgggttggaataaaggtcgactttacaactacgaagatccagagagattccccaatacaagcagagaagcttgtgaatgtaggttatatggagtcgctgttgaattacagttttgaggataagtctcttctagttgaagcattgactcatggttcatacatgatgcctgaaattccaagatgctatcagcggttggagttcctcggtgactctgtattggattatctcataaccaagcatctatacgacaaatatccttgtctgtcccctggactattaaccgacatgcgatcagcttctgttaacaatgaatgttatgccctagtggcggtgaaagcaaacctgcacaaacacatcctgtacgcctctcatcatctccataagcacatctctagaactgtcagtgagtttgaacagtcttctttgcaatccactttcggatgggaatccgatatatcttttccaaaggttcttggagatgtgatagaatctctagcaggcgcgatatttgttgactcaggttacaacaaggaagtagtgtttgcaagtattaaaccacttttgggttgtatgataactccagagactgtcaagttgcatcctgtgagagagttgacagaattatgtcagaagtggcagttcgagttgagtaaagctaaagatttcgattctttcacggttgaggtgaaagctaaggagatgagttttgctcacacagcaaaggcctctgataagaaaatggccaagaaattggcttacaaagaagtcttgaacttacttaagaacagcctggactactaa

SEQ ID NO: 201 - DNA, 4155 bp, Arabidopsis thaliana
atgagtagtttggtggagaggcttcgcatacgatctgataggaaaccagtttataacctagatgattctgatgatgacgacttcgttcctaaaaaagatcgaacctttgagcaagtcgaggctattgtcagaactgatgcgaaagaaaatgcatgtcaggcttgtggggaaagtactaatcttgtaagctgcaatacatgcacttatgcgttccatgctaaatgcttagttccacctcttaaagatgcttccgtggaaaattggagatgccctgaatgtgttagtcctcttaacgagatagataagatattggattgtgaaatgcgtcctacaaaatctagtgaacaaggttcctccgatgcggaaccgaagccaatttttgtgaaacagtatctcgtgaagtggaagggattatcataccttcactgctcttgggtgcctgagaaggagttccagaaggcttataagtcaaatcatcgtttaaaaaccagagtgaacaattttcaccgtcaaatggagtcattcaataacagcgaagatgattttgttgccatacgtcctgagtggaccactgttgatcggattcttgcctgcagagaggaagatggggagctggaatatcttgtcaaatataaagagctatcctatgatgaatgttattgggagtcagaatcagacatctcaaccttccagaatgaaattcaaaggttcaaggatgtaaattctagaactcgcagaagtaaagatgttgaccataaaagaaatcccagagactttcaacagtttgatcatactcctgaattcctcaaaggcttgttacatccataccagcttgagggacttaattttttgcggttctcgtggtcaaaacagacgcatgtaatccttgctgatgaaatgggactaggcaagacaattcaaagcattgcccttttagcttcactttttgaggagaacctcattccgcatttggtaattgctcctctatcgactctgcgtaactgggagagagagtttgccacatgggccccacagatgaacgtggttatgtattttggcactgcgcaagctcgagcagttatcagagaacatgagttttacttatcgaaagatcaaaaaaagatcaagaaaaagaaatctggacaaataagtagcgaaagcaagcaaaaaagaatcaagtttgatgtcctcctcacatcgtatgagatgatcaacctagattcagcagttctaaaaccaattaagtgggagtgcatgattgttgatgaaggtcatcgactgaaaaataaggattcaaagctgttctcttcattgacacagtattcaagtaaccaccgtattcttctgacaggaacaccacttcagaacaacttggatgaacttttcatgctcatgcattttcttgatgcggggaagtttggaagtttggaggagttccaggaggagttcaaagatattaatcaagaggagcagatctcaaggttgcacaaaatgttggctccacatttgctcagaagggtaaaaaaagacgtaatgaaagacatgccccccaaaaaggagctcattttgcgtgttgatctgagcagtctgcagaaagaatattacaaagctatttttacccgtaattatcaagtattgacaaaaaagggaggtgctcaaatttcccttaataacattatgatggaattacgaaaagtatgctgccatccttatatgctagagggtgttgagccagttattcacgacgcaaatgaagctttcaaacaacttttggagtcttgtggaaagctgcaacttctagataaaatgatggtcaaactgaaagagcaaggacacagagtcctaatatacacacagtttcagcatatgctggacttacttgaagactactgtacccataagaaatggcagtacgagcgaattgatggaaaggttggcggagctgagcggcaaatacgcatagatcggttcaatgccaaaaattctaacaagttttgttttttgctctccacaagagctggtggcttaggaataaatcttgcaacggctgatacagtaatcatttatgacagtgactggaatcctcatgctgatcttcaagcaatggctagagctcatcgacttggccaaacaaataaggtgatgatttataggctcataaaccgaggcaccattgaagaaaggatgatgcaattgactaaaaagaaaatggttctagagcatcttgttgttgggaaactcaaaacacaaaacattaatcaggaagagttagatgacatcatcaggtatggatcaaaggagctttttgctagtgaagatgatgaagcaggaaagtctggaaaaattcattatgatgatgcggctatagacaaattgcttgatcgtgatctcgtggaggcagaggaagtctcagtggatgatgaagaggagaatggattcttaaaggctttcaaggtggctaattttgaatatatagatgaaaatgaggcagcagcattagaggcacagagagtcgctgctgaaagcaaatcttcagcaggcaattctgatagagcaagttattgggaagagttgttaaaagataaatttgagctgcaccaggctgaggagcttaatgctcttggaaaaaggaagagaagtcgcaagcagttggtatccattgaagaagatgatcttgctggtttggaagatgtgagctctgatggagatgaaagttatgaagctgagtcaacagatggtgaagcagcaggacaaggagttcagacgggtcgacggccgtacagaagaaagggtcgcgataatttggaaccaactccgttgatggaaggtgaggggagatctttcagagtactgggtttcaaccagagtcaaagggccatttttgtacagactttgatgaggtatggagctggcaattttgattggaaggagtttgttcctcgcttaaagcagaagacctttgaagaaataaatgaatatggaatactcttcttgaagcacattgctgaagaaatagacgagaattctccaaccttttcagatggtgtgcccaaggaaggacttagaatagaagatgttctagtcagaattgctcttctgatactagttcaggagaaggtgaaatttgtagaagatcatccagggaaacctgttttcccctctcgcattcttgaaagattccccggactgagaagtggaaaaatttggaaggaggaacatgacaagataatgatacgtgctgttttaaagcatgggtacggacggtggcaagctattgttgatgacaaagagttggggatccaagagcttatctgcaaagaattgaatttccctcacataagtttgtctgctgctgaacaagctggtttgcaggggcagaatggtagtgggggctctaatccgggagcacagactaaccagaatcctggaagcgttattactgggaacaataatgcttctgctgatggggctcaagtaaactcgatgttctattatcgggacatgcagagacgacttgttgagtttgtgaaaaagcgagttctgcttttggagaaggcgatgaattatgaatacgcagaggaatattatggacttggtggctcatcatctatccctactgaagaaccagaagctgaaccaaagatcgctgacacagtgggagtgagctttattgaggttgatgatgaaatgcttgatggacttcctaagactgatcctatcacttcagaagaaattatgggggctgctgttgacaacaaccaagcgcgggtcgaaatagctcaacattataaccagatgtgcaaacttcttgatgagaacgctcgggaatcagtccaagcatatgtaaacaaccaaccaccgagtaccaaggtgaatgagagcttccgtgcactcaaatctatcaatggtaacattaacacaatcctttcgattacatctgatcaatccaagtcacatgaagacgacaccaagccagacctaaacaatgttgagatgaaggacacggccgaagaaacaaaaccgttaagaggtggcgtcgtcgatctgaatgtggtggagggagaggagaacattgctgaagctagtggaagtgttgatgtaaaaatggaagaagccaaagaagaagagaagccaaagaacatggtcgttgattga

SEQ ID NO: 202 - DNA, 1203 bp, Arabidopsis thaliana
atgtctgtacatgtcaaggaagaacctgtgcttgttccaaactgcgatgtcgagaatacagagcttgcagttttcaatggaaatggagaaagtgagcttgagaattttgggacttgcgtagatgagataacagatagagtgaatcagcttgagcaaaaagttgtggaggtcgaacacttttactctacaaaagatggagctgctcaaactaacacttctaagagtaactcgggcgggaagaagatcgctatttctcaaccaaacaactcgaagggtaactcggccgggaaagaaaaatcaaagggaaaacatgtttccagccctgaccttatgcgtcaatttgcaacaatgtttcgtcagattgctcaacataaatgggcatggccgttcttggagcctgttgatgttaaaggacttggactacatgattattacaaggttatagagaagccaatggacttgggaacaattaaaaaaaaaatggagagttcggagtatagcaatgtcagggagatatatgccgatgttagactagttttcaagaacgcgatgagatacaatgaagaaaaagaagatgtttatgtgatggctgaatctcttctggagaaatttgaggagaaatggctcctgataatgcctaaacttgtggaggaggaaaagaaacaagtagacgaagaagcggagaagcatgccaataagcagcttacaatggaggctgcacaagcggaaatggctagggatttaagcaacgaactatatgagattgatctgcagctggagaaactccgggaatcagtagttcagagatgcagggttcgtaaccgagtttttggtgtggttttggaaataaacagaaaactgtccactcaagaaaagaaaggactttctgcagctctaggtcgtctctcacctgaggatctgtctaaggcgttaaaaatggtttcagagagcaacccgagtttcccggctggagcaccagaagtcgagcttgacattgatgttcagactgacgttacattgtggagactgaaggtgtttgtgcaagaagcattgaaagcagctaacaaaagctctggaggaacaaacgctcaaaacaataacaatactggaactggagagatcaacaagaacaatgcaaaaagacggagagagatctctgatgcaatcaataaagcttcaattaaaagagctaagaaagcttga

SEQ ID NO: 203 - DNA, 2385 bp, Arabidopsis thaliana
atggtacattcagagtcatcaatacttagttccttgcgcggtggtgatggcggtggtattccttgttctaaggatgaactagcaataaatggtagttacaccgatcctatggggcggaggaagtccaagcggtttaaggttgctgcggaaagtgagttttcacctgattttggatcgattaccaggcagctcagatcgagaagaatgcagaaggagttcacagttgagacttacgagaccaggaatgtttctgatgtttgtgttctctcttctcaagctgatgttgagttgattcctggagaaattgttgcagaaagagatagctttaagtcggttgattgtaatgacatgtcggttgggttaaccgaaggagctgaatctcttggagttaacatgcaagaacctatgaaagataggaatatgccagagaacacaagtgagcaaaatatggtggaggtccatcctccaagcataagcctgccagaggaagatatgatggggtctgtttgcaggaaaagcatcactggaacaaaggagcttcacggaagaacgatctctgttgggagagacttatctccaaatatggggagcaagttttcaaagaatggaaagaccgctaaacgttctatatcggtggaagaggaaaacttggttctggagaagtcagattctggagaccatttgggtccatcaccagaggttttggaacttgagaaatcagaggtttggataattacagacaaaggggttgtaatgccttcaccagtgaagccttccgagaagaggaatggagattatggtgaaggatctatgaggaagaatagtgagagggttgccctggataaaaagagattagctagtaaatttcggttatcaaatggtgggcttcctagttgctcaagcagtggggatagtgctcggtataaagttaaggaaacaatgcgtcttttccatgaaacttgtaaaaaaattatgcaagaggaagaagcaaggcctaggaaaagagatggtggcaatttcaaagtggtttgcgaggcttcgaaaattctcaagagtaaagggaaaaatctttatagtggtactcagattattggaactgtgcctggtgttgaggttggcgatgaatttcaatatagaatggagctgaaccttcttggtatacatagaccaagtcaaagtggtatcgactatatgaaagatgacggtggggaactagttgccacgagtattgtatcctcgggaggttataatgacgtgcttgataactctgatgtcttgatctacacgggtcaaggcggaaatgtggggaaaaagaaaaataatgaaccacccaaagaccagcagcttgtaacgggaaaccttgcgttgaaaaacagtataaacaaaaagaaccctgtgcgggtcataagaggcatcaaaaatacgacattacaatcatcagttgttgcaaagaattatgtttacgatggattgtatctggtggaagagtactgggaagaaaccgggtctcacggtaaactcgtcttcaagttcaaactacggcgtattcctggacaacccgagcttccctggaaagaggttgcgaaatcgaaaaaatctgagttccgggatggtctttgcaatgttgatatcacagaagggaaagagacattacccatatgcgctgtgaacaatttagacgatgagaaaccgccaccgtttatctacacggctaaaatgatatatccggattggtgccggccaattcctccaaagagctgcggttgcacaaacggctgctccaagtcaaaaaactgtgcctgcattgtgaaaaacggtggaaagataccttattacgatggagccattgttgaaattaagcccctggtctatgagtgtggcccacactgcaaatgcccaccttcttgcaacatgagagtctcacagcacgggatcaagatcaagctggagatcttcaaaacggagtcaagaggttggggagtgagatcgctggaatctattcctatcgggagcttcatctgtgagtacgcaggagagcttctagaggataaacaagctgaaagccttaccgggaaagatgagtatctttttgatctcggggacgaggatgatccgttcaccataaacgcagcacagaaagggaacatagggaggtttataaaccatagctgctcgccgaatctgtacgcacaggacgtattgtacgaccatgaggaaataagaatacctcacattatgttctttgcactggacaatatacctccacttcaggaactctcgtacgactacaattataagatcgatcaggtatacgactctaatggtaatatcaagaagaaattttgctattgtggttccgctgagtgtagtggtaggctctactaa

SEQ ID NO: 204 - DNA, 6135 bp, Arabidopsis thaliana
atggcgtctaaaggtggtaaatctaaacctgatatagtaatggcgtccaagagtgggaaatctaaacctgataatgaatccagagctaagcgtcagaagacgctcgaagctcctaaagaaccacgtcgtcctaaaactcactgggaccatgtattggaggagatggcttggctgtcaaaggactttgagtctgagaggaaatggaagctggcgcaggcgaagaaggttgctttgagagccagcaaaggaatgctagatcaggcatctagggaagaaaggaagctaaaggaagaagaacagcgacttcggaaagtagccctcaatatctcgaaagacatgaaaaagttttggatgaaagttgagaagctggtgctttacaagcatcagttggtacgcaatgagaagaagaagaaggctatggacaagcaacttgaatttctgttaggccaaactgagaggtactcaaccatgttggcagaaaatttagtggagccttataaacagggccaaaatactccttcaaaacctctactaactatcgaatcaaaaagtgatgaggagagggcagaacagatacctccagagataaattcttgtcttgaatcaggaagtcctgaactcgatgaggattatgatctaaaatctgaggatgagaccgatgaaaaacacttcaccaaacgtgaaagacaggaagagttggaagctttgcaaaatgaagtggatctaccagttgaggagctgctcagacgttatacctctggaagagttagccgagaaaccagcccagtaaaagatgaaaatgaggacaatctgacctcagttagccgagtaaccagcccagtaaaagatgaaaatcaggacaatctggcctcagtaggtcaagatcatggagaggacaagaacaatcttgcagcttctgaagaaactgaagggaacccaagtgttcgtcgttctaatgatagctatggtcatttggcaatatccgagacccattcacatgaccttgagccaggcatgacgactgcatctgtgaagtccagaaaggaagatcatacctatgattttaacgatgaacaggaagatgttgactttgttcttgccaatggtgaggaaaaggatgatgaggcgacattggctgtcgaagaggaactggcgaaagcagataatgaagatcatgtcgaagagattgccctgctgcaaaaagagagtgaaatgcctattgaagtactacttgcaaggtataaggaggatttcggtggcaaggatatatctgaggatgaatctgaatcttcatttgctgtatctgaagactctatagtagactctgacgaaaataggcagcaagctgatttagatgatgacaacgttgatttaacagaatgtaagctagatccagagccttgctcagaaaatgttgaaggcacattccatgaagtagcagaagataatgataaagatagtagtgataaaattgctgatgcagcagcagcagcaagatctgcccagccaactggatttacatactccacaacaaaagttcgaacgaaactgccgtttctacttaagcattctctgcgtgagtaccaacacattggtttggactggcttgtcacgatgtatgagaaaaagttgaacggtattctggctgatgaaatgggtcttggaaagacaattatgaccattgctcttctagctcaccttgcatgtgataagggaatatggggtccccatctgattgtggttcctacaagtgtgatgcttaattgggagactgagtttcttaaatggtgtcctgcatttaaaattctcacctactttggtagtgcaaaggagcggaaactcaagagacaaggatggatgaagcttaactcatttcatgtatgcataacaacctataggctagttattcaggacagtaaaatgttcaagcgcaagaagtggaaatacttgattcttgacgaagcccatttaattaagaattggaagtctcagagatggcagacactattgaacttcaattctaaacgcagaattttgttgactggtacacccctgcagaatgatcttatggaactgtggtcacttatgcactttctgatgccacatgtctttcagtctcaccaggaattcaaagactggttctgtaacccaatagcagggatggtcgagggacaagaaaaaatcaacaaagaagttattgatcgcttacataatgtcctccgtcctttccttctacggcgcctaaaaagggatgtggagaagcaacttccttcgaaacatgagcatgttattttctgtagactgtctaagaggcagcgcaacttgtatgaggacttcatagcaagcacagaaacacaggctacgcttaccagtggaagcttttttgggatgataagtatcataatgcagttgcggaaagtttgtaatcatcctgatctctttgagggtcgtcctattgtaagttcttttgatatggctggcattgatgtgcagttgagttcaacaatctgttcgctactattggaaagtccgttttccaaggttgatcttgaggctttgggattcttattcacccatcttgatttttctatgacttcttgggaaggagatgagatcaaagctatttcaacaccctcagaattaatcaaacagcgtgtgaacttgaaggatgatctagaagcaatccctttgagtccaaaaaaccgcaaaaatctgcaagggacaaatatttttgaagaaattcgtaaggctgtctttgaggaaaggatacaagaatctaaggatcgggcagcagccattgcatggtggaattctttgagatgccagagaaagccgacttactctacatcactaagaactcttttaaccattaagggtcctcttgatgatcttaaagctaactgttcatcttacatgtattcatcaatcctcgctgacatagtcctttcaccaatcgagcgttttcagaagatgattgagctagttgaagctttcacatttgcgattccagctgcacgagtgccttcacctacttgctggtgcagtaaaagtgactctcctgtttttcttagtccatcgtacaaggaaaaagttacagatttattgtcacctcttttatctccaattagacctgcaatcgttaggagacaagtatattttccagataggcgactgatacagtttgattgtggtaagctgcaggagcttgctatgttattgaggaaattaaaatttgggggtcacagagcgttgatattcacgcaaatgaccaagatgcttgacgtcttggaggctttcattaatttatatggttatacctacatgcgtcttgatggctctacacctccagaagagaggcagacgttaatgcagcggtttaatacaaatcccaagatctttcttttcattttgtcaacccgaagtgggggcgttggcatcaaccttgtgggtgcggacacagttatattctatgacagtgactggaatcctgctatggatcaacaagctcaagatcgctgccacaggataggtcagacacgtgaagtgcatatataccggttgataagtgagagcaccattgaggagaatatcttaaagaaagcaaaccagaagcgtgtgcttgataacctagtaattcaaaacggtgagtataacaccgaatttttcaagaagctcgatcccatggaattgttctctgggcataaggctctgactacaaaggatgaaaaggaaacaagcaagcattgtggggcggatatacctctatcaaatgcagatgttgaggctgctctaaaacaggccgaagatgaggcagattatatggctctcaaaagagtagaacaagaagaagctgtggacaatcaagagttcacagaagaacctgtagagagaccagaagacgatgagctagtaaatgaagatgacataaaggctgatgagcctgctgatcaaggtttagttgcagcagggccggccaaagaagaaatgtcattgttacatagtgatatcagggatgagagagctgttatcactacttcaagccaagaagatgacactgatgtattagatgatgtcaagcaaatggctgcagcagcggctgatgctggacaagctatctcatcttttgagaatcagctacgtcctattgatagatatgcgattagatttttagagctttgggaccccatcattgttgaggctgcaatggaaaatgaagcaggatttgaagagaaagaatgggaacttgaccacattgagaagtacaaggaggaaatggaagctgagattgatgatggggaagagcctcttgtttacgagaaatgggatgctgattttgcaactgaggcatacaggcagcaagtggaagtcttagctcagcaccagttaatggaagatttggaaaatgaagctagagagagggaagcggcagaggtggctgaaatggttttgacacagaacgaaagtgctcatgtactgaagcctaagaagaagaaaaaggcgaagaaagccaaatataaatccctgaagaaaggatcactggctgccgaatcaaaacatgtgaagtcagttgtgaaaattgaagattctactgatgatgataatgaagaattcggctatgtgagtagcagtgactcggatatggttacaccgctttcgcggatgcatatgaagggcaagaaaagagatttaattgttgacactgatgaagagaagacctcaaagaagaaagcaaagaagcacaagaagtctctcccgaattcagatatcaaatataagcaaacaagtgcactacttgatgaactggaaccatcaaagccgtctgacagtatggttgttgataatgagttgaaattgacgaacaggggtaaaactgtagggaaaaaattcatcacttccatgccaataaagcgtgttcttatgatcaagccagagaaattgaagaaaggaaatctgtggtctagagattgtgttccctcgcctgattcttggttgccgcaggaagatgctatattgtgtgccatggttcatgaatatgggcctaactggaattttgttagcggaactctttatggaatgacagctggtggggcttacagaggacggtatcggcatcctgcatattgttgtgagagatatagagagcttattcaacgacatattttgtctgcttccgacagtgcagtgaacgagaagaacctcaacacaggttctgggaaggctctccttaaagtcactgaggaaaatattcggacactcctaaatgttgcagctgagcagccagatacggagatgctcctacaaaaacatttttcttgcttgctgtcatcaatttggaggacgtctacccgcactgggaatgatcaaatgctctccttaaacagtcctattttcaacagacagtttatgggttccgtgaatcacacccaagatttagctagaaagccttggcaggggatgaaggtcaccagcttaagtagaaagttgttagaatccgctctccaggattctggcccgagtcagccagacaatactatttcccgttctaggttgcaggagactcaacctatcaataaattgggattagagttaaccttggaattcccacgtggcaatgatgattccctgaatcagtttccaccgatgattagtctgtccattgatgggtcagattcattaaattatgtgaacgagcccccaggggaagatgttctaaaaggttctagggttgctgcagagaaccgttacaggaatgctgcaaatgcttgtattgaagattcatttggatgggcttcaaacacgttcccagccaatgatctgaagtcaagaacaggcacgaaagcacagtccctggggaaacacaagctatccgcctcagactcagccaagtctacaaaaagcaaacaccgcaaactcttagcagagcaattggaaggggcatgggttaggccaaatgatccgaatctcaagtttgatttcacacctggtgatagggaggaggaggaggagcaggaggtggatgagaaagcgaattcagcagagatagagatgataagctgttcacaatggtatgatccattctttacctcaggccttgatgattgctcattagcttcggatatctcagaaatagagtag

SEQ ID NO: 205 - DNA, 4500 bp, Arabidopsis thaliana
atggtgactacaaggtcgcaggagggtgacggaaaggggaaagaggtggagttggaggttccgctggattcccgagttacgcggttagaaacgacggtcgctgagcaacataaggagatgatgaagcagtttgctgatttgtatgcagtgcttagccgatctacagctggtaagatggtggatgagcaatcgacgttagatcggagtgcgccgaggtcgtctcagtcgatggagaacagatccggttaccctgatccatatcgtgatgctcgtcatcagcaggtgcgatcagaccattttaatgcttataataatcttacacggttagggaaaattgattttcctcggtttgatggtacacggttgaaagagtggttgtttaaagtcgaggagttttttggtgtggattcaactccagaagatatgaaggttaaaatggcagcgatccactttgatagccatgcctctacttggcatcagtcctttattcagtcgggtgttggtcttgaggtgttgtatgattggaagggatatgtgaagctgttgaaggaacgatttgaggatgattgtgatgaccctatggcggagctaaaacatttgcaggaaactgatggcatcattgattatcatcagaaatttgagctgattaaaacaagagttaatctctctgaagaatatttggtgagtgtgtacttggcaggactcaggacagacactcaaatgcacgtccggatgtttcagcctcaaactgtgagacattgcttgttcttgggcaagacatatgagaaagcacaccctaagaaaccagctaatactacttggtccacaaatcgttctgcacctactggcggttataacaaatatcagaaggaaggcgagtctaagacagatcattatggaaacaagggaaattttaaaccggttagtcagcaacctaagaaaatgtctcaacaagaaatgagtgataggaggtctaaagggctatgctatttttgtgatgagaagtacactccagaacattatttggttcacaagaaaacacaactgtttcgaatggatgttgatgaagagtttgaagatgctagagaagagttggtaaatgacgatgatgaacatatgccacaaatctctgtcaatgcggtttcaggaatagctggttacaagactatgagagttaagggaacatatgacaaaaagattatcttcatcctgatagactcagggtcgacacacaactttctggatccaaatacagcagctaaacttgggtgtaaggtggacacagctgggttaactcgtgtatctgtagctgatggcaggaaattgcgtgttgagggtaaagttactgatttctcttggaagttgcagactacaacttttcagtctgatatcttattgattcccttacaagggattgatatggtactaggggtgcaatggttggagactttgggtcgtatctcttgggaattcaagaaactggaaatgcgatttaaattcaataatcagaaagtacttttacatggacttacatcaggttctgtcagggaagtgaaggcgcagaaactgcagaaactacaggaagatcaagttcagctggccatgttatgtgtacaagaagtttcggagagtacagaaggggaactttgtactattaatgctttaaccagtgagcttggtgaggagtctgtagtggaagaagtactcaatgagtatcctgatatattcattgaaccgactgctttacctccatttcgtgagaagcataatcataagattaaattgttggaggggtctaatccggtgaatcagcgaccctatcgctattcaatacaccagaagaatgaaattgataaactggttgaggatttacttactaatggaacagtgcaagctagttctagtccttatgcttcacctgttgttttggtcaaaaagaaggatggaacttggagactttgtgttgactatcgtgagttgaatggcatgactgtaaaagatagttttcctattccattgattgaggatctcatggatgagttgggaggtgcagttatcttttccaagatagatcttcgggctggttaccatcaggtgcggatggatcctgatgatatacaaaagacagcatttaaaacgcatagtggccattttgagtacttggtcatgcccttcggactcactaatgcaccggctacgtttcaaggtctcatgaatttcatattcaagcccttcttacgtaagttcgtcttggtcttctttgatgacattctggtttatagttcttccttggaagagcatagacagcaccttaagcaagtgtttgaagtcatgcgagctaataagttgtttgccaaactcagcaaatgtgcttttgcggttcctaaagtcgaatatctaggacacttcattagtgcacaaggcattgaaactgatcctgcgaaaatcaaggctgtgaaggagtggcctcaaccaacaacactcaagcagttgagggggttcttgggtcttgctggttactatcgacgttttgtgcggagttttggggttattgcgggaccattacatgctttgactaaaactgatgcatttgaatggacagcagtagcacaacaagcgtttgaggatcttaaagcggccttgtgtcaagcgcctgtcttatctttgcctctgtttgataaacaattcgtggtagaaactgatgcgtgtggtcagggcataggggcggttttgatgcaagagggacatcctttggcttacattagtcgccaattaaaagggaagcaactacacctatctatctatgagaaagaattgctggcagttatctttgcagtccgaaaatggcgacactatttgctgcagagtcacttcataatcaagactgatcaaagaagtttgaagtatctattggagcagcgtttgaacacaccaattcagcagcagtggcttcctaaattgctcgagtttgactacgagatccagtatagacaaggaaaagaaaatgtagtggcagatgctttgtctcgggtagaaggatctgaggtgttgcacatggctatgacagtggtggagtgtgatttgttgaaggatattcaagcaggctatgccaatgactctcagttacaagatattattactgcacttcaacgtgatccagattcaaaaaaatatttctcttggagtcagaatatactgagaaggaaaagtaagattgtagttccagcaaatgacaacattaagaatacaatattgctttggttacatgggtcgggtgtaggaggacattcaggcagggacgtgactcatcagcgtgttaaaggactgttttactggaaaggcatgattaaggacatccaagcttatattcgcagctgtggtacatgtcaacaatgtaagtctgatcctgcagcttcaccggggttactccagccattaccaatccctgataccatttggagtgaagtgtcaatggattttattgaggggctaccagtttcaggaggcaaaacagtcatcatggttgttgtggatcgcttgagtaaggctgctcacttcattgcattatcacatccttatagtgcattgacagtagcacatgcttacttggacaacgtttttaagttacatggctgccccacttcgattgtcagtgacagagatgttgtgtttacaagtgaattttggagagagttcttcacgttacagggagttgcattgaagttgacgagtgcttaccatccccagagtgacggacaaactgaagttgtgaacagatgtttggagacctacttgcgttgtatgtgccatgacagacctcagttgtggagtaaatggcttgcattggcagagtattggtacaacaccaattaccactcttctagcaggatgacgccatttgagatagtgtatgggcaggtacctccagtccatttaccttatctgcctggggaatcaaaagtggcggttgtggctaggtctttgcaggagagggaagatatgttgctgttcttgaagtttcatttgatgcgcgctcaacaccgaatgaaacaatttgcagaccagcatcgaactgaacgtgaatttgagattggggattatgtctatgtgaagctgcaaccttaccgccaacaatctgtggtgatgcgtgctaatcagaagctgtcaccgaagtattttggcccatataagatcattgatcgttgtggtgaagtggcttataagttggctcttccttcttactctcaagtgcatcctgtgttccatgtttcgcagctaaaggtgctagtgggcaatgtctctacaacagttcatttgccttcagtgatgcaagatgtctttgagaaagtacctgagaaagtggtggaaaggaaaatggtcaatcgtcagggaaaagctgtcactaaagtgttggtgaaatggagcaatgaacctttggaagaagctacatgggagttcctcttcgatttgcagaaaacatttcctgagtttgaagcatag

SEQ ID NO: 206 - DNA, 393 bp, Arabidopsis thaliana
atggctggtcgtggaaaaactcttggatccggtggggcgaagaaagctacatctcggagtagcaaagccggtcttcaattcccggtgggtcgtatcgctcgtttcttaaaagccggtaaatacgccgaacgtgttggtgccggtgctccggtttatctcgccgccgttctcgaatatttggccgccgaggttcttgaattagctggaaacgcagcaagagacaacaagaagacacgtattgttcctcgtcacattcagcttgcggtcagaaacgatgaggagctaagcaagcttcttggagatgtgacgattgctaatggaggagtgatgcctaacatccacaatctccttctccctaagaaggctggtgcttcaaagcctcaggaagattag

SEQ ID NO: 207 - DNA, 6531 bp, Arabidopsis thaliana
atggaacccactgattctactaacgagcaactcggagacactaagaccgccgctgtcaaggaagagagtcgctcctttctcggcatcgatctcaacgaaatccctaccggcgctactctcggcggtggttgcaccgctggtcaggatgacgacggcgaatatgaacctgttgaagttgttaggtcaattcacgataacccggacccagcccctggagcccctgccgaggttcctgaaccggatcgggatgcttcgtgcggcgcgtgtggaagacctgagtctatagagctcgttgtagtctgcgatgcctgtgagcgaggctttcatatgtcttgtgtcaacgatggagttgaggcggctccttccgccgattggatgtgcagcgactgtcgtactggcggcgagaggagcaaactgtggccgttgggggttaagtccaagctcattctggacatgaacgcctcgccgcccagtgatgctgagggatacggagctgaggagacgtctgattcgagaaagcatatgctcgccagcagctcttgcattggaaactcttttgattatgcaatgatgcattcaagcttctcaagtctcggtagaggacatgctagtctcgaagcttcagggttaatgtctcgtaatactaaaatgagtatggatgcattgggttcacataatctaggttttggattcccattaaacttgaacaatagtagtttgcccatgagatttccatccttggatccaagtgagttgtttctgcaaaatctcaggcatttcatatctgaaaggcatggagtattggaagatggctggcgtgtcgaattcagacaacctttaaatggttatcagttatgtgcagtgtattgtgctccgaatggaaaaacatttagttcaatacaagaagttgcttgttatctgggcttggcaattaatggtaactacagctgtatggatgctgaaatcaggaatgagaattctcttcttcaagaaagattgcatacgcccaagagaagaaagacatcaagatggccaaacaatggtttccctgagcaaaagggtagttcagtgagtgctcaactcaggcgttttccattcaatggtcagaccatgtctcctttcgccgttaaatctggtactcattttcaggctggtggttctcttagctctggaaataatggatgcggttgtgaggaagctaagaatggatgtccgatgcagtttgaagatttctttgttctgtcgcttggacgaattgacataagacagtcttaccataatgtcaacgtgatttatccaataggatataagtcctgctggcatgacaagatcacggggtcactatttacatgtgaagtatctgatggcaattctggtcccattttcaaggttacacggtcaccatgctcgaaatcatttattccagctggatcaactgtcttctcctgcccaaagattgatgaaatggtggaacagaacagtgacaaacttagtaatcgtagagatagtactcaagagcgtgatgatgacgctagtgttgagatccttctttcggaacactgcccacctcttggagatgatatattgtcttgtttacgtgagaagagtttctccaagacagtcaattccctgcgctcagaggttgattcttctcgagtagattttgataaaaatttatcctatgatcaggaccatggggttgaaattggtgacattgttgtggaagaagattcattgtctgatgcatggaaaaaagtgtctcaaaaacttgttgatgcatgttcaattgtactgaagcagaagggtaccctgaatttcctatgtaagcatgttgacagagaaacaagtgaaatcaactgggataccatgaatgagaaagacaatgtaattttatcgttgtcaaaattttgctgttcgttggctccttgcagtgtcacgtgtggtgaaaaggataaaagcgaatttgcagcagtagttgatgctttgtcaaggtggctcgatcaaaacagatttggacttgatgcagattttgtacaggaaatgattgaacatatgcctggtgccgaatcatgtacgaattataggactctgaagagtagaagttcttcttctgttcctataactgtagcggaaggagcgctagtggtcaaaccaaaaggtggggaaaatgtcaaggacgaagttttcggtgagatttctcggaaagccaagaagcctaaactaaatggtggtcatggtgtcagaaatctacaccctcctcctgggaggccaatgtgtttgaggctccctcctgggcttgttggtgacttccttcaggtatctgaagtgttctggcgtttccatgaaattttgggttttgaagaggctttctcacctgaaaaccttgaacaggagcttatcaatccagtgtttgatggtttgtttcttgataaacctgggaaagatgataagagaagtgagattaactttactgataaggattctacagctactaaacttttttctttgttcgatgaatctcgccaaccttttcctgcaaaaaatacctctgcttctgaactaaaggagaaaaaggcaggggattcttctgattttaagatttcagattcctctcgtgggtcgtgtgtgggtgcacttctaacaagggctcacatttcgcttctgcaagtgctaatatgtgagctgcaatccaaggtagctgcatttgttgatccaaactttgattctggcgaatcgagatccagacgaggacgaaaaaaggatgacagtacactttctgctaaaagaaataagctgcatatgcttcctgttaatgagttcacttggcctgaattggcccgtaggtacatcttgtctcttttatccatggatgggaacctcgaatcagcagagattgctgcacgtgaaagtggtaaggtattccgttgcttacaaggggatggtggtttgctttgcggctcgcttacaggagtggctgggatggaagcagattcaatgttacttgcagaggctattaagaaaatatctggttcgttgacaagcgaaaatgatgttctttctgtggaagatgatgattccgatggccttgatgctactgagacaaacacttgcagtggtgatattccagagtgggctcaggttttggaacctgtgaaaaagcttccaacaaatgttgggactagaatcagaaagtgtgtctatgaagctttagagagaaatccaccagagtgggcaaagaagatattggagcattctatcagtaaagaaatatataaaggcaatgcatcaggaccaacaaagaaagctgtcctctcattgctagcggatattcgaggtggagacttggtgcagaggtctattaaaggaaccaaaaagcggacatatataagtgtatctgatgtcattatgaagaaatgccgtgctgtattgcgtggtgttgcagctgcagacgaggataaagtcctttgcactttactgggaagaaagttactgaattccagtgataatgatgatgacgggctcctgggatcacctgcaatggtttcgcgtcccttagacttcagaactattgatttgaggttggctgctggtgcgtatgacggatcaactgaagcttttcttgaagatgttcttgagctgtggagtagtatacgtgttatgtatgcagatcagcccgattgtgtggacctggttgcaacattgtctgaaaaattcaagtcgttatacgaggctgaggttgtaccacttgttcagaaacttaaggactacaggaaattggaatgcctaagtgcagagatgaagaaggaaattaaggacatagttgtttcagtaaataagcttcccaaggccccgtgggatgagggggtatgtaaagtatgtggcgttgacaaagatgatgacagtgttctcttgtgtgatacatgcgatgctgagtatcacacatattgtttaaatccacctcttattagaattcctgatggaaattggtattgtccatcttgtgtcattgccaagcgcatggctcaagaggctttggaatcttacaaactagttaggcggcggaaaggtagaaagtatcagggggaactcacccgagcttctatggaactgactgctcacctggcagatgtgatggaagaaaaggactactgggagtttagtgctgaggagagaatcttgctgcttaagcttctatgcgatgaactgcttagttcatctcttgtccatcaacaccttgagcagtgtgccgaagcaataattgaaatgcagcagaagttacgctctctttcctcagaatggaaaaacgcaaaaatgcggcaagaattcctgacggctaaactggcaaaggttgaaccgagtattctgaaggaagtgggcgaaccacataattcaagctactttgcagaccaaatgggatgtgatccacaaccacaggagggcgttggagacggagttactcgtgatgatgagacttcctctactgcatatcttaacaagaatcaaggtaaatctccacttgaaaccgatactcaacccggagagtcgcatgttaatttcggtgagagcaaaatttcctccccggaaacaatatcatcccctgggaggcatgagctacctatagcagatacctctcctcttgtaacagataatctgcctgaaaaagatacctcggagaccttgcttaagtcagttggaaggaatcatgaaacacattcaccaaattccaatgcagtagaattgccgacagctcatgatgcatcttctcaggcttcccaagagttgcaggcttgtcagcaggatttgagtgccactagtaatgaaattcagaatcttcagcaatcaattagaagcatagaatcacagcttctaaagcaatctatacggagagattttctgggaaccgatgctagtggtcggttatattggggttgctgcttcccagatgaaaatcctcgtatattggttgatggaagcatatctttgcagaaacctgttcaagccgatttgataggttcaaaagtcccctctccgtttctccataccgttgaccatggaagactaaggctttcaccctggacgtattatgaaactgaaaccgagatcagtgagcttgtccaatggcttcatgatgatgatctgaaagaaagagacctgagagagtctattttgtggtggaaaaggttacgatatggagacgttcaaaaggaaaagaaacaagctcagaatttatctgctccggtatttgctacgggtcttgagaccaaggctgccatgtcaatggagaagagatatggtccatgcatcaaactggagatggaaaccttaaaaaaacgggggaagaagacaaaggttgcagagcgagagaaattgtgtagatgcgaatgcttggaatccattttgccatctatgattcactgcctcatatgccataaaacattcgcaagtgatgatgagtttgaggatcacactgagagtaagtgtattccttattcattagcaactgaagaaggcaaggacatctctgattcttcaaaagccaaagaaagtctgaaatccgattatcttaatgtaaagtctagtgccggcaaagatgtagctgaaatatccaatgtttctgaacttgattctgggttgataagatatcaagaagaagaatctatttccccataccattttgaggagatctgttccaagtttgtgacaaaggattgcaacagagatttggttaaagagatcggtctgatcagttcaaatggcattccaacatttcttccatcgtcatctactcatcttaacgactccgtgctcatctctgccaaatccaataagccagatggtggtgattcaggggatcaggtcatttttgctggtcctgaaaccaatgttgaaggcttaaattctgaatctaacatgtcattcgatagatctgtcacagacagtcacgggggtccactggataaaccaagtggactgggttttggcttctcagagcaaaagaataagaaatcttcaggtagtgggttgaaaagctgctgtgtggttccacaggctgctttgaaacgagtaactggcaaagctttgccgggtttcaggttcctgaaaaccaacttgcttgatatggatgtagcactgcctgaagaagctttaagaccatcgaaatcacatccaaaccgtagaagagcttggcgtgtatttgttaaatcgtcgcaaagtatatacgagttggttcaggcaacaattgtggtagaagatatgattaagacagagtacttgaaaaatgaatggtggtactggtcttctctttcagcggctgctaaaatctcgactctctcagcgttatccgtccgtatcttctccctcgacgctgctatcatttatgataaacccataactccatcaaatcctatcgatgaaacaaagccgatcatcagcttaccggaccaaaagtcacagccggtttcggattctcaagaaagaagcagcagagttagaagatctggcaagaaaaggaaagaacccgagggatcctag

SEQ ID NO: 208 - DNA, 1191 bp, Arabidopsis thaliana
atggttcttcttagtttctccttaagattcattgcgttcactctgactataactctgactcagattgctgatgggtttcagagtcgaatgttgatgaacaatggacttgctctctctcctcaaatgggatggaacagctggaatcattttcagtgtaatatcaatgaaacccttatcaaacaaaccgctgatgcaatggtttcaagtggtctttctgcaataggttacaagtatatcaacatagatgattgttggggtgaactcaagagagattctcaggggagtttggttgcaaaagcatcaacatttccttcaggaatcaaagctttatcagattatgttcatagcaaagggctaaaacttgggatatactctgatgccgggactcttacctgcagccaaaccatgccgggatcactcgggcatgaagaacaagatgccaagacatttgcctcatgggggattgattacctcaagtatgataactgcgaaaatacagggacaagtccaagagaaagataccctaagatgagtaaagcgctgttaaattcaggaagatccatattcttctctctgtgcgaatggggacaagaggatccagcaacttgggcaggagatattggcaacagttggagaacaacaggagatatccaagataattggaaaagcatgacattgatagcggatcagaatgatcgatgggcatcttatgcaagaccaggatcgtggaacgatccagacatgcttgaagtgggaaatggaggcatgactaaggaagaatacatgtcgcatttcagcatctgggcattggcaaaagctcctctgctgatcggctgcgatcttagatcgatggacaaagttacatttgaattgcttagcaacaaagaggtgattgctgttaatcaagacaaacttgggatccagggaaagaaagtaaagaaagaaggtgatcttgaggtatgggcaggtccactaagcaagaaacgagtagcggtcatcctatggaacagaggatcagcatctgcaaacatcacagctcgatgggctgagattggcctcaattcatcagatattgttaatgctcgtgacttatgggagcattcgacatattcatgtgttaaaaagcagctatctgccctagtggagcctcatgcctgcaaaatgtatactcttacaagacgcaaggcataa

SEQ ID NO: 209 - DNA, 3273 bp, Arabidopsis thaliana
atggcggaaaatacggccagccatagaagaaaacctcggagcttgaacgatcgtcactacagtatcctccaggatctttctgcgcctcctagacagcctccctcttcttctcatggagaagatgaagagacgaagaagtccatgattaagcttgctggacgacgtcgtctttgcaaggccttgccaaaggaagacgaagctgatggatatgacgatcctgatttggttgatttctattccccagttaaaggagagacatcactagacagcgctggaattgggaacaaattcacatcttgggatgaatcaaaggaagctaacactgagctggctggcgagcctaacttttcgataatcacagacttttgttcgccctcacctcagttgaagcaaaaagaggaaatgcaaggtgatggaggaaggaacgagatcatgggtattttggatgatttgacctctaagcttgggacaatgtcgattcagaagaagaaggatagccaaagcaatgattttgatgcatgtggagtgaagagccaggttgataaatttgattttgaggatgccaaatcctcattttccttgctatcggatctatctaagtcctcaccagatgtggttaccacatataatgctggcgttaatagtatcaaggacaagcaaggcaaatctggttttgccatccgggaagagcaaactagtaaggaattttcaagggaatgggaagaaagaatttcgaatgttggaaagcaaaactcatattctggtcggcactttgacgataactctgaagataataggcagggatacaatcttgaccgtgggaagagccaatgcaaggaagtcgaccaaagtatgaagacgaccaggcacatagaggtaagtgagaagataagaacagtcggaaggtctaatgctgccaagctaagagacttagacgaggatgatgatgatgatgactgtctcattttgtccgggaaaaaggcggctgaaatgaaaattaataagccagctcggtcttataacgccaaaagacatggttatgatgagagatcgttggaagatgaagggtctatcactttaactggcctcaatttgtcttacacattgcctggaaagattgcaacaatgttatatccacatcagagggaagggttgaattggctttggtcattgcatacccaagggaaaggtggaatacttggagatgatatgggtttaggtaaaactatgcagatttgtagttttcttgctggtttattccactccaaattgatcaagcgtgctctggtagtggccccaaaaaccttgctgcctcactggatgaaagaattagctaccgtgggactttcacaaatgactagggaatactacggtacttctacgaaagcccgggaatatgatctccaccacattctgcagggtaaaggtattcttctaacaacctatgatattgtgcggaacaatacaaaggctttgcaaggtgacgaccattatactgatgaggatgatgaagatggaaacaaatgggactacatgattctggacgagggacatcttattaagaaccccaacacacaaagggcgaagagtttgcttgagatcccaagttctcaccgtattataataagtggtacaccaatccagaacaatctcaaggaactgtgggctctcttcaacttcagctgccctgggttactcggtgacaagaattggtttaagcagaattatgagcattacattcttcgtggaactgacaaaaatgctactgatagagaacagaggataggctcaacagtagcaaagaacttgagggagcatattcaacctttcttcttgcggcgccttaagagtgaagtcttcggtgatgatggtgcaacctccaaactttcgaagaaggacgaaattgttgtatggttacggttaacagcttgccagaggcaattatatgaagctttcttaaacagtgaaattgttctgtcagcttttgatggttcacctctagcagctctaacgattctgaagaaaatatgtgaccacccgcttctcttaactaagagggctgctgaggatgtccttgaaggaatggattcaacattaacacaagaagaagcaggcgtggctgagagattggctatgcatatagcggacaatgtggatacagatgattttcagaccaagaatgacagtatctcttgcaaattgtcatttatcatgtcgctactggaaaatttaattccagaggggcaccgtgttctaatcttctcccagacacgcaagatgcttaatctcattcaggattctcttacctccaacggttatagtttcttgcgaattgatggtacaacaaaagcccctgacagattgaagactgttgaagaatttcaagaaggtcatgtggctcctatatttctcttgacttctcaagttggtggtctcggccttactctgactaaggcagaccgtgtgattgtggtggaccctgcctggaatccaagcacggacaaccagagtgttgatcgagcatatagaattgggcagacaaaggatgtcatcgtatataggttaatgacctcagcaactgttgaagaaaagatatacagaaagcaggtatacaagggaggattgtttaaaactgcaactgagcataaagaacaaatccgctacttcagccagcaggaccttcgagaactttttagtcttcccaagggaggctttgatgtttcacctacacaacagcaactatacgaagagcactataaccaaatcaaactagatgaaaaactggaatcccatgtaaagtttctcgaaacccttggtatagctggagttagccaccatagcttacttttctccaagacagctcctattcaagcgatacagaaagatgaagaagaacaaataaggagagaaacagcattgctcttgggacgcgcatcagcaagtatttcacaagacaccgtcatcaatggggctgactatgctttcaagccaaaggatgtgaatttggacaagagaatcaacatttccccagtcgatgacaaggaattgtcagaaagcgtaattaaagcaagactcaatcgtttgacgatgctattacaaaacaagggtacggtctcaaggctacctgatggaggggcaaaaatccagaagcagattgctgaattgactcgagaactgaaagacatgaaagcagcagaaaggatcaacatgcctcaagttattgacttggaggaggatataagtcggaagatgcaaaaaggattgaatctgtag

SEQ ID NO: 210 - DNA, 4824 bp, Arabidopsis thaliana
atggactggatacacaaatctactccttttatggaaccttcgaatttggcaaaactggttcaaggaaatgttcctcttcagccacatgacagccattcttcgctaactgatctagatatggaccttagagaagtctatttcctgattttacattttctttctattggcccctgcgaacgaacctttggccacttgagagacgaaattttggaaaaagggcttttaccccgtagatatcattcctggtggtcaagaagtggcatttatagcgggcgtgctgatgatgatggcatctccctccccttgagttatgataatttgatagagaggtatcctcatatcgaaaaggatcacttggtgaagcttctcaaacaactaattttaaacccgtctttcccttcacacatgagagttgaaggaaatgctcctaatgctgctgatgttccaacactattgggatctggcaccttttcacttgtggatcgtagtaattcttattcatctactttgtccaacatgttcctttggatctgggacttgaaaaaatcccatatatgcatagaacctgatagtggctctaaggctttgcattttagaaatttgtttttctggctttggcaatctttacttggtatcatgacttgtattgggaattctggtgaagtagctcatataggagaagttaagtccaggggtaacaatatagagtctcagaaagctaggcatgttgcgtcatacttacgctggccgcatatgcatgccgatcaagtgcgtggcctaagtctcagagaaattggaggaggtttcaggaaacaccaccgtgctccgtccattctttcagcatgtcatgctattgcaaaaccatcaacaatggttcaaaagatgcaaaatataaagaagctcagaggacatcgtaatgctgtctactgcgctatatttgatcgttctggaagatatgttatcactggctccgatgaccggcttgtcaaaatttggtcaatggaaactgcgctttgcttggctagctgccgtgggcatgaaggtgacattacagacttggccgttagttcaaacaatgctttggttgcttcagcttcaaacgattttgtgattcgagtgtggcggttgcctgatggaatgccaatttctgtattgcggggacacactggagctgttaccgcaattgcattcagtcccagacaggcgtctgtttaccaacttttatcgtcatcagatgatggaacctgtcgtatctgggatgctaggtattctcagtggctcccacgaatctatgttccaagtccttcagatgctaacactggctcattggaagtttctctcttaggcgaaagcacttttacatcttccaacacaggatccacgagcaatgcatctcagagtcatcaaatattatgttgtgcatacaatgctaatggaaccattttcgtcacgggtagctctgacagcaatgcaagggtttggagtgcctcaaaacctaacttggatgatgctgaacagccgactcatgagctggatgttctacggggccatgagaatgatgtcaactatgtgcaatttagtggttgtgctgtggctccaaaatcttcaacagctgatgctctgaaggaagatagctacccaaagtttaagaattcctggttttgtcatgacaatatagtaacctgctctcgcgatggtagtgcaattatatggactccaagatcacgtaaattccatgggaaatctggacgctggatgaaaggatatcatctgaaggttccacctcctccacttcctccacaacctcctcgaggaggcccacgtcaaaggtttcttccaacaccacggggtgttaatatgattatatggagcttggataatcgttttgtacttgccgctatcatggattgcaggatttgtgtttggaatgctgctgatggtagcttagtgcattgtttaactggtcacagtgaatcgtcttatgtcttggatgtccatcctttcaatcctcggattgctatgagcgctggctatgatgggaaaacaatcatctgggatatatgggagggtataccaatcaaagtgtacgaaatcgggagatttaagttggttgatggaaagttttcacaagatgggacatctattgtgctttcagatgatgttggccagatatattttctaaacacaggacaaggagagtctcaaaagaatgcaaaatacgaccagttcttccttggtgattatcgtcctcttattcgagataccaatggacatgttcttgatcaggagacgcagctacttcctcatcggaggaaccttcaggatcttctttgtgattcaagtatgattccgtatccagaacctgaccagacaatgtttcagcaacgcagacttggtgcattaggagttgaatggcgtccttcctcgataaagttttctgttggccctgattttagtttaggtcaagattatataatgcctcctttggctgatctggatagactgattgagccattgcctgagtttatagatgctatgtactgggaaccagaacacgaagttctgagtgacgacaatgattcagagtataatgctgaagtttcctctgatggggctagggcaagcccatgttccaactcttcaaatgaacttgagtgcagctccgaggacagtgacgttgaaaatattcacgaaagtagctatcattggaaaagaagaagaaaacatcctaaggtcaacgtctctacttcatctggaagacgtgataagaggattttggatgagaatgatagctcgaattctggaattaagagaaccaagaaccgaagaattgtcgtgaaggcttcaaaaagaaaacattctgatgtcaaagcatcacggccgcagagagcagcagctcaaaatgctcgatccttgctttctaaaatttctggaagctcttcggatgaagttgatgatgataatgattcatccaacagtgaatctgatagaagcatacccactttgcgacagttggacaaaccatctcagatgctggaatctctttcaaatgacaaacagaagaaaagattgattgtaaagatctctgttaagaagccagcagagtctatgggaagcaagggagatgtgataaatcaggctgatttagagcaactatcttccaaacctttggaggagaatcacagagtgattggtatatattccagagaacccgggtcaagttctgtagatgcaaaaggtgattcagggtgtcagagtattccctactctatgaatacgccacagagagaaaaggccgataatcagttgataagatcttcagatcaagaccagaatatgtgcaagtggagggaagagattcctgtttgtgaacctaccgaattaactgcgcctgagaacatagaagaagcccaaccattttatggggatgaagctgatgagattcttccaaagaaagttcgacgactgaggttaaagcttcggcatcccaacagtcctcgaaaactagaacctgatgaggtggcagatgatttggcagatggtggagatgggtttgcatccatagctccctctttcatgaatccgattatggattctgaacctgtgatagatagcgttagagattcttctgcacataactttgagtttggagaagctacagctgatgtgatacgtaggaaaagatccataagaagtgaatctagtacaagaaatagcgcattacgcataaggttgggctctggatctgtagacaaaataaagaaacaagggattccttccacaagcgtgtatgatgatgcatcacttgaagaatggccttctacctcaaaagctgggtccaggtctagatctgcaagcgtcagcaaaccaagtcttcatactgggataaggttgaatagtgtctcaggaaaaatctcatggttattgttgtctgaacacgaggaaggctgccgttatatacctcagctaggggatgaagttatttacttcaagcagggtcatcaagagttccttaaaactaaagaattaaatgacagggaccgatcaaggtaccttccccgaaacctaggagcagtagagatttgcaaagtcgagaaacttaactatgatacatatcctggttctggagatagctgctgcaaaatgaccctcagggttctggattcttcttcatcacatgcctcccgcaaagagtttcaactgacacttcctgagctcattaatttccctgattttattgtggagaagactcgatacgacgctgcaattcaaacaaactggaaaattggtaatgagtgccgtgtgtggtggagagacgcaaccggtgaaggcggggcttggtgggaaggtaggattgagtcttcacaagtaaaatccactgacttcccagagagtccatgggaaagatacagagttgtctatgaaacaggggaaacgagtcttcacagcccgtgggagtttgacaatcccgagtttccctgggaaaaatctaccatcgaagatgagagaagagagaaactgctttcattatttgctggactagtaaaatcaatcagcaagcatcaggatagttacgggatccaaaagctaaacgaagcagctcaaaagatggatttctgcaataggttcccggttccattataccctgagctgattcacgaaagactagagaatcagtactacagaagtattgaatcgtttaaacacgacgtggatgcaatgctctcaaatgcggagttgtatttcgttagaagtgcacatatgctttcgaagataaagcgactgcgagataaattgacaaaaacgttaagaaagctgatctga

SEQ ID NO: 211 - DNA, 2745 bp, Arabidopsis thaliana
atggtgggactggaagatgatactgagagagagaggtcaccagtcgtagagaatggtttttccaatgggtctcggtcttcttcttctagcgcaggtgttttgtctccatcacgaaaggtcactcaggggaacgatacactttcttatgccaatattcttcgggcaagaaacaagtttgctgatgcgcttgctctctatgaggctatgctggagaaagatagcaagaatgttgaagctcacattggaaaagggatatgcttgcagacgcagaacaaagggaatctagctttcgattgtttttctgaagcgatcaggttggatccgcataatgcttgtgcccttacacactgtggtatacttcataaagaagaaggacgcctcgtagaagctgctgagtcctaccagaaagcattgatggcagatgcatcatacaagccagcagcagagtgtttagccattgttttgaccgaccttggaactagcctgaagctggctgggaatactcaggaaggaattcaaaagtattacgaagcccttaagattgacccacactatgctcctgcatattacaacttaggtgttgtatactccgaaatgatgcaatatgacaatgccttgagctgctacgagaaggctgcacttgagaggcctatgtatgctgaagcatattgtaacatgggtgtcatttataagaaccgtggtgacttggagatggcaatcacttgttatgagagatgtctagctgtgtctccaaactttgagattgcgaagaacaatatggccatagctctgacagatttaggaacaaaggttaaacttgaaggcgatgtaacccaaggagtggcatattacaagaaggctctctattataactggcactatgcagatgctatgtacaatcttggggtggcttatggagaaatgctaaagttcgacatggcgattgtcttctatgagcttgctttccactttaatccacattgtgctgaggcttgcaacaatttgggagtactttacaaagaccgtgacaaccttgataaagctgtggagtgttatcagatggctctatcaatcaaaccaaattttgcacagtcgcttaataaccttggtgtcgtctatacagtccaggggaaaatggatgctgctgccagcatgattgagaaggctatacttgctaatcccacatatgcagaagcttttaacaacctaggtgttctttacagagatgctggaaatataactatggctatcgatgcttatgaggaatgccttaagatagatccagattctcgcaatgctggccagaaccgattgcttgccatgaattacataaatgaaggactcgatgacaaactatttgaggctcacagagactggggttggcgcttcacaagattacaccctcaatacacttcatgggataatctgaaagatccagagcgacctatcaccattggatatatctcaccagatttcttcactcattcagtatcttatttcattgaagctccccttacgcatcatgattatacaaagtacaaagtggtggtttattcagcggtagttaaggcagatgcaaaaacatacaggtttagggataaagtgttgaagaaaggtggagtttggaaggatatatacgggatagatgagaaaaagatagcaagtatggtcagagaggacaaaatcgacattttggtagaactcactggtcatacggcaaacaacaagttgggaacaatggcctgcagaccagcaccggttcaggttacttggatcggctatccaaatactacgggtttgcccactgttgattacagaattacagattcgttggctgatccaccagataccaaacaaaagcaggtcgaggagctggttaggcttccggactgttttctttgttatacaccttccccagaggctggtcctgtttgtccaacacctgcgctttctaatggctttgtcacatttggtagtttcaacaacctcgcaaagataactcctaaggtgctgcaagtgtgggctaggatactgtgtgcagttcccaattctcgtctagtggtaaaatgcaaacctttctgctgcgatagcattaggcagaggtttctcaccacgctggagcagcttgggttagaatcaaagcgtgttgatctcttgcctttgattcttttcaatcacgaccatatgcaagcctattccttgatggatattagtttggacacattcccttatgctggaactaccactacctgtgagtctctctacatgggagttccatgtgttacaatggctggctcagtacatgctcataatgttggtgtcagtcttctcactaaagttggattaggacacctggttgccaaaaatgaggatgagtatgttcagctatctgttgatctagcctctgatgtcacagctctttctaaattgagaatgagtctccgggatctaatggctggatctcctgtttgtaatggtccttcctttgctgttggtcttgaatccgcatatcggaatatgtggaaaaagtactgcaaaggtgaagtgccgtccttaaggcgaatggaaatgctgcaaaaagaggtccatgatgatcccttaatctcaaaagacttgggaccatcaagagtcagcgttactggagaagccactccgtctctcaaggccaatggttctgctcctgtaccttcctctttaccaacccaatccccgcagctctcaaagagaatggactccactagctag

SEQ ID NO: 212 - DNA, 3522 bp, Arabidopsis thaliana
atggctagttcatcttcatctgagagatggatcgatggtcttcagttctcttccttgttatggcctccgccacgagatcctcaacaacataaggatcaagtcgttgcttatgttgaatattttggtcaatttacatcagagcaattcccagatgacattgctgagttggtccggcatcagtatccatcaactgagaagcgacttttagacgatgtgctggcgatgtttgtccttcatcatccggagcatggtcatgcagtcattcttccaatcatttcatgtcttattgatggctcgttggtgtacagcaaggaagctcatccgtttgcctctttcatatctttagtttgcccaagtagtgagaatgactattcggagcaatgggctttggcatgtggagaaatccttcgcattttgactcattacaaccgtcccatttataaaactgagcagcaaaatggagatacagagagaaattgtctgagcaaagctacaactagtggttctccgacttcagagcctaaggctggatcaccaacacagcatgaaaggaaacctttaaggcctttgtctccatggatcagtgatatactacttgctgctcctcttggtataagaagtgactatttccgatggtgtagtggtgtaatgggtaaatatgctgctggagagctcaagccgccaaccattgcttctcgaggatctggtaaacatcctcaactgatgccttcaaccccaagatgggctgttgctaatggagctggtgtcatactgagtgtttgtgatgatgaagttgctcgatatgagactgctacgctgacagcggtcgctgtccctgcacttcttcttcctccgccaacgacatccttagatgagcatctagttgctggccttccagctcttgaaccatatgcacgtttgtttcatagatactatgccattgcaactccaagtgctacgcagagacttcttcttggactcttagaagcaccaccgtcgtgggctccagatgcacttgatgctgctgtacagcttgtggaactccttcgagctgctgaagattatgcatctggtgtaaggctacccaggaactggatgcatttgcacttcttgcgggctataggaattgctatgtctatgagggcaggtgttgctgctgatgctgcagccgctttgcttttccgcatactctcacagccggcactgctttttcctccgctaagtcaagttgagggagtagaaattcagcacgcgcctattggtggctacagttcaaattacagaaaacagatagaagttcctgcagcagaagcaaccattgaagccactgcccaaggaattgcctcaatgctttgtgctcatggtcctgaagttgagtggagaatttgcactatatgggaagctgcttatggtttgatccctttaaattcttcggcggttgatcttcccgaaatcatagttgctaccccactgcaacctcctatcttgtcatggaatttatacattccactcctcaaagtacttgaatatcttccacgggggagtccttcggaagcatgcttgatgaaaatatttgttgccactgtggaaacaatactcagtagaacttttccgcctgaatcttccagggaactaaccagaaaagctagatcgagttttaccacaagatcagcgaccaaaaatcttgctatgtctgagcttcgtgctatggtccatgctctctttttagaatcatgcgctggtgtggaattagcttcacgcctactttttgttgtgttgactgtatgtgttagccatgaagcacagtctagtggtagcaagagaccgagaagtgaatatgctagtactactgaaaatattgaggcgaatcaacctgtatctaacaatcaaactgctaaccgtaaaagtaggaatgtcaagggacagggacctgtggcagcatttgattcatacgttcttgctgctgtttgtgctcttgcctgtgaggttcagctgtatcctatgatctctggtggggggaacttttccaattctgccgtggctggaactattacaaagcctgtaaagataaatgggtcatctaaagagtatggagctgggattgactcggcaattagtcatacgcgccgaattttggcaatcctagaggcactcttttcattaaaaccatcttctgtggggactccatggagttacagttctagtgagatagttgctgcggccatggttgcagctcatatttccgaactgttcagacgttcaaaggccttgacgcatgcattgtctgggttgatgagatgtaagtgggataaggaaattcataaaagagcatcatcattatataacctcatagatgttcacagcaaagttgttgcctccattgttgacaaagctgaacccttggaagcctaccttaagaatacaccggttcagaaggattctgtgacctgtttaaactggaaacaagagaacacatgtgcaagcaccacatgctttgatacagcggtgacatccgcctcaaggactgaaatgaatccaagaggaaaccataagtatgctagacattcagatgaaggctcagggagaccctcagagaagggtatcaaagatttcctcttggatgcttctgatcttgcgaatttcctcacagctgatagactcgcagggttctattgtggtacacaaaagcttttgaggtcagtgcttgcagagaaaccggagctgtctttctccgttgtttcactgttatggcacaaactgattgctgctcctgaaatccagcccaccgcagaaagcacctctgcgcaacaaggatggagacaggttgttgatgcgctatgcaatgtcgtatctgcaacgccagcgaaagcagcagcagcagttgtccttcaggctgaaagggagttgcagccttggatcgccaaagatgatgaagaaggccaaaaaatgtggaaaatcaaccaacggatagtcaaagtgttggtggaactcatgcgcaatcatgacaggcctgagtcactggtgattctcgcaagtgcatcagatcttcttctgcgggcaactgatggaatgcttgttgatggagaagcttgtacattacctcaacttgagctacttgaagccacggcaagagcaatacagccggtgctagcttgggggccatctggactagcagtggtcgacggtttatccaatctattgaagtgtcgtctaccagcaacaatacggtgcctttcacacccaagtgcacacgtacgtgccttaagcacgtcagtactacgtgatatcatgaaccaaagctccatacccatcaaagtaactccaaaactgccaacaacagagaagaacggaatgaatagtccgtcctatcgattcttcaacgccgcctcaatagactggaaagccgatatccaaaactgtttaaactgggaagctcacagcttgctctccacaactatgcctactcagtttctcgacactgcggctcgggaactcggctgtactatatccttgtcccaataa

SEQ ID NO: 213 - DNA, 3090 bp, Arabidopsis thaliana
atgggaacgaaagtctcagacgatcttgtttccaccgtcagatcagtcgtgggttccgattactcagatatggatataatcagggctttacacatggcgaatcatgatccaacggctgctatcaatataatcttcgacactccaagtttcgccaaacctgatgtagccactcctaccccgagcggctctaatggagggaagcgagttgatagtggattaaagggctgtacttttggtgacagcggaagtgttggagcgaatcatcgcgtggaggaagaaaatgagagtgttaatggtggaggagaagagagtgtttcagggaatgagtggtggtttgttggttgttctgaattggctgggttatcgacatgtaaaggaaggaaattgaagtctggtgatgaattggtgttcacgtttccgcatagtaaaggattaaagcctgagactacgcctgggaagcgcggttttgggcggggaaggccagctttgcgtggtgcttctgatatcgttaggttctctacaaaggattcaggagagattggtagaataccaaacgagtgggctcggtgtcttctaccacttgtgagagacaagaaaattaggatagaaggcagttgcaagtcggcgcctgaagctttgagcatcatggatacaattcttctgtctgtaagcgtgtacattaatagttccatgtttcaaaagcatagtgcgacttcatttaagacagctagtaatacggcagaggaatcaatgttccatcctctcccaaatctctttcggttactcggtttgatcccctttaagaaggcagagtttactccagaggatttttactctaagaagcgacctttgagttccaaggatggttctgctattcctacttcgttgcttcaattaaacaaggtcaagaatatgaatcaagatgcaaacggagatgaaaatgagcagtgtatcagcgatggtgatcttgataacattgttggtgttggggacagttctggattaaaggaaatggaaactccacatacacttctgtgtgagcttcgtccataccaaaagcaggcacttcattggatgacccaactggagaaaggaaattgcactgatgaggcagcaacaatgcttcacccgtgttgggaagcatactgtttagcagacaagagggaactggttgtctacctgaattcttttactggtgatgctacaatacacttccctagcacacttcaaatggcaagaggaggaatattagcagacgcaatgggtcttggaaagactgtaatgaccatatcccttttgcttgcccattcttggaaagctgcatcaactgggtttctatgccccaactatgaaggagacaaagtgatcagcagttctgtagatgatctcactagtcccccggtgaaggcaaccaaatttctaggctttgataagaggcttcttgaacaaaaaagtgtacttcaaaatggtggtaacctgattgtatgtccgatgacacttttaggacagtggaagacagagattgaaatgcatgcaaagcctgggtctctatctgtctatgttcactatgggcaaagcaggccgaaggatgcaaaacttctttcccagagtgatgtggtaatcaccacatatggagttctaacatccgaattctcgcaagagaactcagcagaccatgaaggaatttatgcagttcgatggtttaggattgttcttgacgaggcacataccatcaaaaactcaaaaagccaaatttccttggctgctgcagctctggttgctgataggcgttggtgtcttacgggtactcctattcagaacaatctggaggatttatacagccttctacggtttttgaggattgaaccatggggaacttgggcatggtggaataaacttgtccaaaagccatttgaagagggtgatgagagagggttaaagctagtgcagtctatcttaaaacctatcatgcttaggagaacaaagtctagcacagaccgagaaggaaggccgattcttgttctaccccctgctgatgcacgggtcatttactgtgaactttcggagtctgagagggatttctacgacgcgctatttaaaagatccaaggtcaaatttgatcaatttgttgaacaaggcaaagttcttcataactatgcttcgatcctggaactgcttttgcgtcttcgacaatgttgtgatcacccatttttagtaatgagtcgaggggatacagcggaatactctgatctgaataagctttctaaacgtttccttagtggaaagtcttctggcttagaaagggaaggaaaagatgtaccgtcagaggcttttgttcaggaggtggtagaggaactgcgcaaaggagagcaaggagagtgtccaatatgccttgaagcacttgaggatgctgtattaacgccatgtgctcatagattatgtcgtgagtgtctcttggcaagttggagaaattctacttctgggttatgtcctgtgtgtaggaacactgtaagcaaacaagaactcatcacagcaccaaccgaaagtagattccaggttgacgtggaaaagaattgggtggaatcatcgaaaatcactgctcttctggaagagcttgaaggtcttcgttcttcaggctctaagagcattctctttagccagtggaccgctttcctcgatctcctccaaattcccctctctcggaataacttttcatttgtccgtcttgatggcacgctaagtcagcagcaacgagagaaggtccttaaagaattttccgaagatggcagtatcctggtactgttgatgtctctaaaagctggtggcgttgggataaatctaacagctgcgtccaatgcttttgtcatggatccatggtggaacccagcggtagaggaacaagctgttatgcgtattcatcgtatagggcaaactaaggaagtcaaaatcagaagattcatcgttaagggaacggttgaagagagaatggaggcggttcaggcgaggaagcagagaatgatctctggggctttaaccgatcaagaagtacgaagtgcacgtatagaggaactcaagatgttatttacctga

SEQ ID NO: 214 - DNA, 1953 bp, Arabidopsis thaliana
atgggttcttctcacattcctcttgatccgtctctaaatccgtcaccttcactgatcccaaagcttgaaccagtcactgaatcaacccaaaacttggcctttcaacttccaaacacaaacccacaagccctaatttcatcagccgtctccgatttcaacgaagccacagacttttcctcagattacaacaccgtcgccgagtcagcccggtctgctttcgctcaacggcttcaacgtcacgatgatgttgcggttcttgattccttaaccggagcaatcgtaccggttgaggagaatccggaaccggaaccgaatccttactcaaccagtgactcttcaccgtcggttgctactcaacgacctagaccgcagccacgttcgtcggagctagtgaggatcactgatgttggacctgaaagtgagagacagtttcgtgaacatgtgaggaagacgagaatgatttatgattctcttaggatgtttttgatgatggaagaagctaaacgtaatggggttggtggaagaagagctagagctgatggtaaagctggtaaagctggttcaatgatgagagattgtatgttgtggatgaatcgtgataaacgaatcgtcggttcgattcccggtgttcaagttggggatatcttcttctttaggtttgagttatgtgtcatgggcttacatggacaccctcaatctgggatcgattttcttacagggagtcttagttctaatggggagccaatagctactagtgtgattgtttctggtgggtatgaggatgatgatgatcaaggagatgtgattatgtatacaggtcagggtggacaagataggcttggaaggcaagctgaacatcagaggctggaaggtggaaaccttgcgatggaacggagtatgtattatgggattgaagtgagagttattagagggttgaagtatgagaatgaggtttctagtagagtttatgtttatgatgggttgtttaggattgttgattcttggtttgatgttgggaagtctggtttcggtgtgtttaaatatcggttggagaggattgaaggacaggctgagatgggtagttcggtgttgaagtttgctaggactcttaagactaatccattgtctgtgagaccgagaggttacatcaatttcgatatctcgaatgggaaggagaatgttcctgtctatttgtttaacgacattgacagcgatcaagaacctttgtattatgagtatcttgcgcaaacttcgtttcctcctggcttatttgttcagcaaagtggtaatgcaagtggatgtgactgtgtcaatggttgtggcagtggctgcctttgtgaagccaagaattcaggtgagattgcttatgattataatgggacgctaataagacagaaaccgttgatacatgaatgtggatcagcgtgtcagtgccctccaagctgtcgaaaccgtgtgactcaaaagggtttgaggaataggctagaagtgtttaggtcactggaaacgggttggggagttcggtctttggatgtattacatgctggtgcttttatttgtgagtatgctggggttgctttgacaagggaacaagccaacattctgaccatgaacggtgatacattggtatatcctgctcgtttctcttctgcgagatgggaagattggggagatctgtctcaggtccttgctgatttcgagcggccttcttatcctgatattcctccggttgatttcgcaatggatgtgtccaagatgaggaatgttgcttgttacataagccacagtactgatccgaatgtcattgtccagtttgtactccatgatcacaacagtctcatgttccctagagtcatgcttttcgctgctgaaaacatccctcccatgactgagctcagccttgattacggagtagttgatgattggaacgccaagcttgccatttgtaattaa

SEQ ID NO: 215 - DNA, 1659 bp, Arabidopsis thaliana
atggttgtagaaactatcgagaggtcttgtgagggttcaaagagaagacatgtgaacggtggagatatcgctgttccttgttcgggagaagagtgtagcaatggagatataaatgtagctcctggagtttcagcgaaaagagctagggtttctagagaaatgacgtttgaagatatttacggtgctgatgcattactcaatgatgacgatgatgaggatgatgattgtgattgggaacctgtgcaggcgcctatggagtttgtaaaatggtgttgtgtcaattgcactatgtcgaaccctggtgatatggtccactgttgtatatgcggtgagcacaaggaatctggcattttgaggcatggatatttagcgtctcccttttttaaagacactggtctcattgaagtcgaggagaaatatggaggaagctcatctgcaaccagctcgacagctgttgggttcgacgagagaatgttgctacactcagaatttgaagtgaaggcacaaccacatccagagagacctgatcgtcttcgagctatagctgctagtcttgccacagctggtgtttttcctggaagatgcttgcctatcaatgcaagggaaatcacgaaacaagaactccagatggtccacacttcagagcatgttgatgctgttgatactacaagccagcttctctatagctacttcacctctgacacatatgctaatgagtattcagcacgtgctgctagacttgcagcaggtttgtgcgctgatctagctacagatattttcactggccgtgtaaaaaatggttttgctttggttagacctcccggtcatcatgctggcgtcaggcatgctatggggttttgccttcacaataatgcagccgttgctgcattagtagcacaagcagcaggggcaaagaaggtgctgattgtggactgggatgtccatcatggcaacggaacccaagagatattcgaacaaaacaaatctgtattgtacatatccttgcacagacatgagggaggaaacttctatcccggtactggagctgctgatgaggttggttctaatggtggggaaggttattgtgtaaatgttccatggagttgcggtggagttggggataaagactatatctttgcgtttcaacatgtggttctccccatagcttctgcattttctccagattttgtcatcatatctgcgggatttgatgcggctagaggagacccactaggatgctgtgatgtgactccggctggctattctcgaatgacacagatgttgggtgatctgtgtggtgggaaaatgctagttattctcgagggcggctacaatcttcgctccatatctgcttctgcaacagcagtgatcaaggtgcttctgggtgaaaatccggagaacgagttgcccatcgccaccacgccttcagtagccggcctgcaaactgttcttgatgtactgaatatccaactggagttctggccatcacttgctatcagctactccaaattactctcagagttggaagcacgtctgatcgaaaacaaaaaaaatcagatgaaaaggaaggttgttcgggttccgacatggtggaaatggggacgaaagaagcttttgtacaactttctctcggctcgtatgatttcaagatcaaagtga

SEQ ID NO: 216 - DNA, 756 bp, Arabidopsis thaliana
atgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttgatcggtaccagaaatgcagctatggatccattgaagtcaacaacaaacctgccaaagaacttgagaacagctacagagaatatctgaagcttaagggtagatatgagaaccttcaacgtcaacagagaaatcttcttggggaggatttaggacctttgaattcaaaggagttagagcagcttgagcgtcaactggacggctctctcaagcaagttcggtccatcaagacacagtacatgcttgaccagctctcggatcttcaaaataaagagcaaatgttgcttgaaaccaatagagctttggcaatgaagctggatgatatgattggtgtgagaagtcatcatatgggaggaggaggaggatgggaaggtggtgaacagaatgttacctacgcgcatcatcaagctcagtctcagggactataccagcctcttgaatgcaatccaactctgcaaatggggtatgataatccggtatgctcagagcaaataactgcgacaacccaagctcaggcgcagcagggaaacggttacatcccggggtggatgctctga

SEQ ID NO: 217 - DNA, 942 bp, Arabidopsis thaliana
atggtgctttcgcaaaagcttcatgaagcatttaaaggaacagttgagaggatcacaggtcctcgtacgatctcggcgttcaaggagaagggagttctcagcgtcagcgagttcgtacttgccggagataatctcgtctccaagtgtcccacctggtcttgggaatctggtgacgcaagcaaaaggaagccatacttgccctcggacaaacagtttttgattactagaaatgtaccttgtctacggagagctgcttctgtggcagaggattatgaagctgctggaggtgaagtgttggttgatgatgaagataatgatggttggctggctacacatgggaaaccgaaagataaaggcaaggaagaggataacttaccatccatggatgccttggatataaacgagaaaaatactatccaatcaatacctacgtattttggaggtgaggaggatgatgatattccagacatggaggagttcgatgaggctgacaatgtggtagaaaatgatccggcaactcttcagtcaacttatcttgtggctcatgaacctgatgacgataacattctccgaactcggacatatgatctcagcataacgtatgataagtattaccaaactcctcgtgtttggctgaccggttatgatgagtcaaggatgctgctgcaacctgaacttgtaatggaggatgttagccaagaccatgctcgtaaaacggtcacaatcgaagatcatccacacttgcctggtaaacatgcttcagttcatccatgtcggcatggagctgttatgaagaaaatcattgatgtattaatgtcgcgtggagtagaacctgaagtcgacaagtacctcttcctgttcttgaagttcatggcatcagttattccaacaattgagtacgattacacaatggactttgatctcggtagctcaagcacctaa

SEQ ID NO: 218 - protein, 103 aa, Arabidopsis thaliana; identical to SEQ ID NO: 152

SEQ ID NO: 219 - protein, 995 aa, Arabidopsis thaliana
MSAQMEEPETLGKRKESESSKLRSDETPTPEPRTKRRSLKRACVHEVAVPNDYTPTKEETIHGTLDNPVFNGDMAKTYPFKLDPFQSVSVACLERKESILVSAHTSAGKTAVAEYAIAMAFRDKQRVIYTSPLKALSNQKYRELQHEFKDVGLMTGDVTLSPNASCLVMTTEILRAMLYRGSEVLKEVAWVIFDEIHYMKDRERGVVWEESIIFLPPAIKMVFLSATMSNATEFAEWICYLHKQPCHVVYTDFRPTPLQHYAFPMGGGGLYLVVDDNEQFREDSFVKMQDTFPKPKSNDGKKSANGKSGGRGAKGGGGPGDSDVYKIVKMIMERKFEPVIIFSFSRRECEQHALSMSKLDFNTDEEKEVVEQVFNNAMQCLNEEDRSLPAIELMLPLLQRGIAVHHSGLLPVIKELVELLFQEGLVKALFATETFAMGLNMPAKTVVFTAVKKWDGDSHRYIGSGEYIQMSGRAGRRGKDERGICIIMIDEQMEMNTLRDMMLGKPAPLLSTFRLSYYTILNLLSRAEGQFTAEHVIRHSFHQFQHEKALPDIGNKVSKLEEEAAILNASGEAEVAEYHNLQFDIAKHEKKLMSEIIRPERVLCFLDTGRLVKIREGGTDWGWGVVVNVVKNSSVGTGSASSHGGGYIVDTLLHCSTGFSENGAKPKPCPPRAGEKGEMHVVPVQLPLISALSRLRISVPSDLRPVEARQSILLALQELSSRFPLGFPKLHPVKDMNIQDTEIVDLVSQIEEVEQKLLAHPMHKSEDDQQIKSFQRKAEVNYEIQQLKSKMRDSQLQKFRDELKNRSRVLKKLGHIDADGVVQVKGRAACLIDTGDELLVTELMFNGTFNDLDHHQVAALASCFIPVDKSNEQVNLRNELTKPLQQLQDSARKIAEIQHECKLEIDVEEYVESTIRPFLMDVIYSWSKGASFAEIIQMTDIFEGSIIRSARRLDEFLNQLRAAAEAVGESSLESKFAAASESLRRGIMFANSLYL

SEQ ID NO: 220 - protein, 1196 aa, Arabidopsis thaliana
MGSEGNMKKSVVTQVSIGGFGESTTAKQLTDYLEDEVGIVWRCRLKTSWTPPGSYPNFEIADTSNIPSIDEYKKVEPHAFVHFAVFESAGRAMDAAGQCNLILDGQPLKVSLGPKNPYSLNQRRRTTVPYKLAGITLEIGTLVSRDDFFVSWRAEGVDFLVDPFDNTCKFCFRKSTAFSFKDAVMHAVINCDYKLELLVRDIQTVRQYKTLHGFVLILQLASSPRVWYRTADDDIYDTVPGDLLDDDDPWIRTTDFTQVGAIGRCHSYRVLISPRYENKLRTALDYFRMRRVQEERVRWPPRIRNEPCFGEPVSDHFFCIHHKEGISFEIMFLVNSVLHRGVFNQFQLTERFFDLLRNQPKDVNIASLKHLCTYKRPVFDAYKRLKLVQEWIQKNPKLLGSHEQSEDISEIRRLVITPTRAYCLPPEVELSNRVLRRYKAVAERFLRVTFMDESMQTINSNVLSYFVAPIVKDLTSSSFSQKTYVFKRVKSILTDGFKLCGRKYSFLAFSANQLRDRSAWFFAEDGKTRVSDIKTWMGKFKDKNVAKCAARMGLCFSSTYATVDVMPHEVDTEVPDIERNGYVFSDGIGTITPDLADEVMEKLKLDVHYSPCAYQIRYAGFKGVVARWPSKSDGIRLALRDSMKKFFSKHTILEICSWTRFQPGFLNRQIITLLSVLGVPDEIFWDMQESMLYKLNRILDDTDVAFEVLTASCAEQGNTAAIMLSAGFKPKTEPHLRGMLSSVRIAQLWGLREKSRIFVTSGRWLMGCLDEAGILEHGQCFIQVSKPSIENCFSKHGSRFKETKTDLEVVKGYVAIAKNPCLHPGDVRILEAVDVPQLHHMYDCLIFPQKGDRPHTNEASGSDLDGDLYFVAWDQKLIPPNRKSYPAMHYDAAEEKSLGRAVNHQDIIDFFARNLANEQLGTICNAHVVHADRSEYGAMDEECLLLAELAATAVDFPKTGKIVSMPFHLKPKLYPDFMGKEDYQTYKSNKILGRLYRRVKEVYDEDAEASSEESTDPSAIPYDAVLEIPGFEDLIPEAWGHKCLYDGQLIGLLGQYKVQKEEEIVTGHIWSMPKYTSKKQGELKERLKHSYNSLKKEFRKVFEETIPDHENLSEEEKNILYEKKASAWYHVTYHPEWVKKSLELQDPDESSHAAMLSFAWIAADYLARIKIRSREMGSIDSAKPVDSLAKFLAQRL

SEQ ID NO: 221 - protein, 743 aa, Arabidopsis thaliana
MSDALSAIPAAVHRNLSDKLYEKRKNAALELENIVKNLTSSGDHDKISKVIEMLIKEFAKSPQANHRKGGLIGLAAVTVGLSTEAAQYLEQIVPPVINSFSDQDSRVRYYACEALYNIAKVVRGDFIIFFNKIFDALCKLSADSDANVQSAAHLLDRLVKDIVTESDQFSIEEFIPLLKERMNVLNPYVRQFLVGWITVLDSVPDIDMLGFLPDFLDGLFNMLSDSSHEIRQQADSALSEFLQEIKNSPSVDYGRMAEILVQRAASPDEFTRLTAITWINEFVKLGGDQLVRYYADILGAILPCISDKEEKIRVVARETNEELRSIHVEPSDGFDVGAILSVARRQLSSEFEATRIEALNWISTLLNKHRTEVLCFLNDIFDTLLKALSDSSDDVVLLVLEVHAGVAKDPQHFRQLIVFLVHNFRADNSLLERRGALIVRRMCVLLDAERVYRELSTILEGEDNLDFASTMVQALNLILLTSPELSKLRELLKGSLVNREGKELFVALYTSWCHSPMAIISLCLLAQAYQHASVVIQSLVEEDINVKFLVQLDKLIRLLETPIFTYLRLQLLEPGRYTWLLKTLYGLLMLLPQQSAAFKILRTRLKTVPTYSFSTGNQIGRATSGVPFSQYKHQNEDGDLEDDNINSSHQGINFAVRLQQFENVQNLHRGQARTRVNYSYHSSSSSTSKEVRRSEEQQQQQQQQQQQQQQQQRPPPSSTSSSVADNNRPPSRTSRKGPGQLQL

SEQ ID NO: 222 - protein, 862 aa, Arabidopsis thaliana
MAQFLRRFSSSPMANEDEFQSPVEPSQQQSQDCVSESYLIGFVIANIVGLKYYSGRINGREMVGLVREPLNVYDNNAIRVLNTRSEQVGHIERTVAAVLAPMIDSHTIVVEGIVPNTRSNSNRYRIPCQIHVFAKLEASSTVKSTISRGGLVLISESDTSFGLSEAVVVKEQMGNGDKRSVDKIFKLVDENVKLMGKLVAAEPPREVIKSELFAHQKEGLGWLLHREKSGELPPFWEEKDGEFLNTLTNYRSDKRPDPLRGGVFADDMGLGKTLTLLSLIAFDRYGNASTSTPTEEPLDGEGDKIEKKGKKRGRGKSSESVTRKKLKTDDVVGMNVSQKTTLIVCPPSVISAWITQLEEHTVPGILKVYMYHGGERTDDVNELMKYDIVLTTYGTLAVEESWEDSPVKKMEWLRIILDEAHTIKNANAQQSRVVCKLKASRRWAVTGTPIQNGSFDLYSLMAFLRFEPFSIKSYWQSLIQRPLGQGNKKGLSRLQVLMATISLRRTKEKSLIGLPPKTVETCYVELSPEERQLYDHMEGEAKGVVQNLINNGSLMRNYSTVLSIILRLRQLCDDMSLCPPELRSFTTSTSVEDVTDKPELLQKLVAALQDGEDFDCPICISPPTNIIITRCAHIFCRACILQTLQRSKPLCPLCRGSLTQSDLYNAPPPPPDSSNTDGEDAKSSTKSSKVSALLSLLMASRQENPNTKSVVFSQFRKMLLLLETPLKAAGFTILRLDGAMTVKKRTQVIGEFGNPELTGPVVLLASLKASGTGINLTAASRVYLFDPWWNPAVEEQAMDRIHRIGQKQEVKMIRMIARNSIEERVLELQQKKKNLANEAFKRRQKKDEREVNVEDVVALMSL

SEQ ID NO: 223 - protein, 588 aa, Arabidopsis thaliana
MAEEKKNKKKKSDAKVDSEETGEEFISEHSSMKDKEKKRKKNKRENKDGFTGEDMEITGRESEKLGDEVFIVKKKKKSKKPIRIDSEAVDAVKKKSKKRSKETKADSEAEDDGVEKKSKEKSKETKVDSEAHDGVKRKKKKSKKESGGDVIENTESSKVSDKKKGKRKRDDTDLGAEENIDKEVKRKNNKKKPSVDSDVEDINLDSTNDGKKKRKKKKQSEDSETEENGLNSTKDAKKRRKKKKKKKQSEVSEAEEKSDKSDEDLTTPSTSSKRVKFSDQVEFFPSDDDEGTEDDDEEEVKVVRGKRFTKEEDEMVKNAVLEYIDNHALGDEGIKMVMECKAYPQLKGCWKEITSALPWRTYNSVYHRAHTIFEAGSQGIWTKEDIELVMEFQKTHGNDWKTLADAMGKHRKHVKDAWRRGRLAGKKKGHWMREEYQNLFDLVNKDLRMKAFKEKHSKHGMLKDNIPWMAISDVLETRDHVTCCQKWYEQLISPMVAKGMWANVDDYRLLEELLKLDAACIDDVDWDNLLENRDGEACRKRWNQMIIHIGVPKSKTFAEQVEILSDRYCPDIAEDREDFDNRPYDPED

SEQ ID NO: 224 - protein, 296 aa, Arabidopsis thaliana
MENGESNQENLKSLNHDESLKKPSASSVVVDRLKRDEWSEGAVSTLLEAYESKWVLRNRAKLKGQDWEDVAKHVSSRATHTKSPKTQTQCKNKIESMKKRYRSESATADGSSWPLYPRLDHLLRGTQPQPQPQAVLPLNCSVPLLLLEPPLPAVAHPPQISYGSNGVGKIPKEDGFKPENKPEKDAEMDTDSSTPVVKTKVRGKKVKRRYKEEKEEIAGSIRWLAEVVMRSERARMETMKEIERMRAEAEAKRGELDLKRTEIMANTQLEIARIFAAAASSGQNKGVDSSLRIGRN

SEQ ID NO: 225 - protein, 669 aa, Arabidopsis thaliana
MQGVPGFNTVPNPNHYDKSIVLDIKPLRSLKPVFPNGNQGPPFVGCPPFGPSSSEYSSFFPFGAQQPTHDTPDLNQTQNTPIPSFVPPLRSYRTPTKTNGPSSSSGTKRGVGRPKGTTSVKKKEKKTVANEPNLDVQVVKKFSSDFDSGISAAEREDGNAYLVSSVLMRFDAVRRRLSQVEFTKSATSKAAGTLMSNGVRTNMKKRVGTVPGIEVGDIFFSRIEMCLVGLHMQTMAGIDYIISKAGSDEESLATSIVSSGRYEGEAQDPESLIYSGQGGNADKNRQASDQKLERGNLALENSLRKGNGVRVVRGEEDAASKTGKIYIYDGLYSISESWVEKGKSGCNTFKYKLVRQPGQPPAFGFWKSVQKWKEGLTTRPGLILPDLTSGAESKPVSLVNDVDEDKGPAYFTYTSSLKYSETFKLTQPVIGCSCSGSCSPGNHNCSCIRKNDGDLPYLNGVILVSRRPVIYECGPTCPCHASCKNRVIQTGLKSRLEVFKTRNRGWGLRSWDSLRAGSFICEYAGEVKDNGNLRGNQEEDAYVFDTSRVFNSFKWNYEPELVDEDPSTEVPEEFNLPSPLLISAKKFGNVARFMNHSCSPNVFWQPVIREGNGESVIHIAFFAMRHIPPMAELTYDYGISPTSEARDESLLHGQRTCLCGSEQCRGSFG

SEQ ID NO: 226 - protein, 1706 aa, Arabidopsis thaliana
MNVQAHMSGQRSGQVPNQGTVPQNNGNSQMQNLVGSNGAATAVTGAGAATGSGTGVRPSRNIVGAMDHDIMKLRQYMQTLVFNMLQQRQPSPADAASKAKYMDVARRLEEGLFKMAVTKEDYMNRSTLESRITSLIKGRQINNYNQRHANSSSVGTMIPTPGLSQTAGNPNLMVTSSVDATIVGNTNITSTALNTGNPLIAGGMHGGNMSNGYQHSSRNFSLGSGGSMTSMGAQRSTAQMIPTPGFVNSVTNNNSGGFSAEPTIVPQSQQQQQRQHTGGQNSHMLSNHMAAGVRPDMQSKPSGAANSSVNGDVGANEKIVDSGSSYTNASKKLQQGNFSLLSFCPDDLISGQHIESTFHISGEGYSTTNPDPFDGAITSAGTGTKAHNINTASFQPVSRVNSSLSHQQQFQQPPNRFQQQPNQIQQQQQQFLNQRKLKQQTPQQHRLISNDGLGKTQVDSDMVTKVKCEPGMENKSQAPQSQASERFQLSQLQNQYQNSGEDCQADAQLLPVESQSDICTSLPQNSQQIQQMMHPQNIGSDSSNSFSNLAVGVKSESSPQGQWPSKSQENTLMSNAISSGKHIQEDFRQRITGMDEAQPNNLTEGSVIGQNHTSTISESHNLQNSIGTTCRYGNVSHDPKFKNQQRWLLFLRHARSCKPPGGRCQDQNCVTVQKLWSHMDNCADPQCLYPRCRHTKALIGHYKNCKDPRCPVCVPVKTYQQQANVRALARLKNESSAVGSVNRSVVSNDSLSANAGAVSGTPRCADTLDNLQPSLKRLKVEQSFQPVVPKTESCKSSIVSTTEADLSQDAERKDHRPLKSETMEVKVEIPDNSVQAGFGIKETKSEPFENVPKPKPVSEPGKHGLSGDSPKQENIKMKKEPGWPKKEPGCPKKEELVESPELTSKSRKPKIKGVSLTELFTPEQVREHIRGLRQWVGQSKAKAEKNQAMENSMSENSCQLCAVEKLTFEPPPIYCTPCGARIKRNAMYYTVGGGETRHYFCIPCYNESRGDTILAEGTSMPKAKLEKKKNDEEIEESWVQCDKCQAWQHQICALFNGRRNDGGQAEYTCPYCYVIDVEQNERKPLLQSAVLGAKDLPRTILSDHIEQRLFKRLKQERTERARVQGTSYDEIPTVESLVVRVVSSVDKKLEVKSRFLEIFREDNFPTEFPYKSKVVLLFQKIEGVEVCLFGMYVQEFGSECSNPNQRRVYLSYLDSVKYFRPDIKSANGEALRTFVYHEILIGYLEYCKLRGFTSCYIWACPPLKGEDYILYCHPEIQKTPKSDKLREWYLAMLRKAAKEGIVAETTNLYDHFFLQTGECRAKVTAARLPYFDGDYWPGAAEDIISQMSQEDDGRKGNKKGILKKPITKRALKASGQSDFSGNASKDLLLMHKLGETIHPMKEDFIMVHLQHSCTHCCTLMVTGNRWVCSQCKDFQLCDGCYEAEQKREDRERHPVNQKDKHNIFPVEIADIPTDTKDRDEILESEFFDTRQAFLSLCQGNHYQYDTLRRAKHSSMMVLYHLHNPTAPAFVTTCNVCHLDIESGLGWRCEVCPDYDVCNACYKKEGCINHPHKLTTHPSLADQNAQNKEARQLRVLQLRKMLDLLVHASQCRSPVCLYPNCRKVKGLFRHGLRCKVRASGGCVLCKKMWYLLQLHARACKESECDVPRCGDLKEHLRRLQQQSDSRRRAAVMEMMRQRAAEVAGTSG

SEQ ID NO: 227 - protein, 915 aa, Arabidopsis thaliana
MPSDIMEQRGVSTPSHFHEDIHITSERQFGFMKTDMMPENQGGRDRLSSMPKSSWTSESYQLKPQSSFSGSHPSGSPNARNTTNGSQWESSLFSSSMSDLFSRKLRLQGSDMLSTMSANTVVTHREEEPSESLEEIEAQTIGNLLPDEDDLFAEVTGEVGRKSRANTGDELDEFDLFSSVGGMELDGDIFSSVSHRNGERGGNNSVGELNRGEIPSRTLLVGNISSNVEDYELKVLFEQFGDIQALHTACKNRGFIMVSYCDIRAAQNAARALQNKLLRGTKLDIRYSISKENPSQKDTSKGALLVNNLDSSISNQELNRLVKSYGEVKEIRRTMHDNSQIYIEFFDVRAAAAALGGLNGLEVAGKKLQLVPTYPEGTRYTSQCAANDTEGCLPKTSYSNTSSGHIGRHFPGMISSTSSDGGSMRVIHNSIGSPVNSFIERHRSLSIPIGFPPSANGISASKPVGLQEHGHHFDNSNMGIQSMPNLHPHSFSEYVDNFANGSPYTSSAFSEMVSDGSKANEGFMIHNVRGVEGFSGGGIGSPMHQSSRRPINLWSNSNTQQQNPSSGMMWPNSPSHINSIPTQRPPVTVFSRAPPIMVNMASSPVHHHIGSAPVLNSPFWDRRQAYVAESLESSGFHIGSHGSMGIPGSSPSHPMDIGSHKTFSVGGNRMDVNSQNAVLRSPQQLSHLFPGRSPMGSMPGSFDSPNERYRNLSHRRSESSSSNADKKLYELDVDRILRGEDRRTTLMIKNIPNKYTSKMLLSAIDEHCKGTYDFLYLPIDFKNKCNVGYAFINLIEPEKIVPFFKAFNGKKWEKFNSEKVATLTYARIQGKTALIAHFQNSSLMNEDKRCRPILFHTDGPNAGDQEPFPMGSNIRSRPGKPRSSSIDNYNSFSISSVSENREETPNGTDPFLKEN

SEQ ID NO: 228 - protein, 136 aa, Arabidopsis thaliana; identical to SEQ ID NO: 162

SEQ ID NO: 229 - protein, 1210 aa, Arabidopsis thaliana
MHPKRSSQGDGSVTKPVRTSDRLRRRPKLHGRSYLYYSSPNMLHNRKRNTKTRTAASQIAKMLHKGNRPARASNAAPIASDLRRSTRKRRISVNLEDYTDSSGAEDEDMMSPAYRTLRRRVHKNFSTSKSRKDMDAELAPRREGLRPRRSTTIANKRLKTESGADQDTSEEKDGQDETENGNELDDADDGENEVEAEDEGNGEDEGDGEDEGEEDGDDDEEGDEEQEGRKRYDLRNRAEVRRMPTGEINKQQQPRSPRRVLHQGMGTRVGRDGRRGGSRPHKRHRFTRTDDSDDSLLVDELDQGPAIPWARGGNRSGAPWLFGGLDTYGSSSLGLNVGASGWGHQSDGLAALTSGVQTAGPSSKGGADIQPLQINEDINFDDIGGLSEYINDLKEMVFFPLLYPEFFASYSITPPRGVLLCGPPGTGKTLIARALACAASKAGQKVSFYMRKGADVLSKWVGEAERQLKLLFEEAQRNQPSIIFFDEIDGLAPVRSSKQEQIHNSIVSTLLALMDGLDSRGQVVLIGATNRVDAIDGALRRPGRFDREFNFSLPGCEARAEILDIHTRKWKHPPTRELKEELAATCVGYCGADLKALCTEAAIRAFREKYPQVYTSDDKYAIDVGLVNVEKSHFVEAMSAITPAAHRGSVVQSRPLSPVVLPCLHRHLLESMSLISDIFPSSATSSELTKLSILTFGSAIPLVYRPRLLLLGGEGVGLDHLGPAILHELEKFPIHSLGLPSLLSDPGAKTPEEALVHIFSEARRTTPSILYIPMFNNWWENAHEQLRAVFLTLLEELPSNLPILLLATSYGELSDMEEQSVFDNRSVYTVDKPSSEDRSLFFDRLIEAALSVISGLNGKPDGPQPLPELPKVPKEPTGPKPAEVKAKVEAEQHALRRLRMCLRDVCNRILYDKRFSAFHFPVTDEDAPNYRSIIQIPMDTATLLQRVDTGQYLTCTPFLQDVDLIVRNAKAYNGDDYAGARIVSRAYELRDVVHGMLSQMDPALLTYCDKIAAEGGPSLIPDDLSGSILGLAPVVQMGTVTRTSARLRNVQPEVNLDRDYEGLKKPKKTTDAVSIDSAADKSQNQDSGQEMPSPDAANPQSAAPSPTDGDREDQSEPPSKEASAEDMSGDSCKGPAAKSDKEISSRTESVKGVFMERTDNYSIPQMERLYTRIMKGVLETLDKGLRDDDNNPKHSILRFLSEFAQHQANF

SEQ ID NO: 230 - protein, 533 aa, Arabidopsis thaliana
MKRDHHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRKVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 231 - protein, 175 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 232 - protein, 1495 aa, Arabidopsis thaliana
MADEEEGENSNKLMLVALTATMTKLLDARLEAFRQEHINSDPDRDRTRREPRDPVDDRDTMSYYSQSSRQTNHRRRRHDREERVLPRDDLAGLKIRIPSFKGTNDPDEYLEWEKKIELVFNCQQYTEESKVKVAPTEFQNYALSWWDQLVTTRRRAGDYPIESWTQMKTIMRKRFVPSHYYRELHNRLRNLVQGNKSVEEYYKEMETLMLRADIQEDNEAIMSRFMGGLNRDIIDRLEVQHYVELEELLHKAIMFEKQLKRRSSKPSFGSGKPSYHKDERSGFQKDYKPFIKPKVEDQDQKGKGKAVMTRTRDIKGFKCQGHGHYASECSNKRIMIIKDTGEIESEDEQLEESSSTEDYEAPSKGELLVTMKALSVIAKTDEQEQRENLFHSSCMVNDKVCSLIIDGGSCTNVASETMVEKLGLKVMKHPRPYKLQWLNEDGEMSVDRQVKVPLSIGKYEDEILCDILPMEASHILLGRPWQSDRKDYTDVFPEENPVGLPPIRGIEHQIDFVPGASLPNRPAYRTNPVETKELEKQVTELMERGHIRESMSPCAVPVLLVPKKDGSWRMCVDCRAINNITVKYRHPIPRLDDMLDELHGSSIFSKVDLKSGYHQIRMKEGDEWKTAFKTIQGLYEWLVMPFGLTNAPSTFMRLMNHVLRAFIGRFVIVYFDDILVYSKSLEEHVEHLKMVLEVLRKEKLYANLKKCTFGTDNLVFLGFVVSTDGVKVDEEKVKAIREWPSPKSVGEVRSFHGLAGFYRRFVKDFSTLAAPLTEVIKKNVGFKWEQAQEDAFQALKEKLTHAPVLSLPDFLKTFEIECDASGVGIGVVLMQDKKPIAYFSEKLGGATLNYPTYDKELYALVRALQTGQHYLWPKEFVIHTDHESLKHLKGQQKLNKRHARWVEFIETFPYVIKYKKGKDNVVADALSRRYVLLSSLDAKLLGFEHIKSLYANDSDFEKIYSSCEKFAFGKYYRHDGFLFYDNRLCIPNSSLRELFIREAHGGGLMGHFGVSKTIKVMQDHFHWPHMKRDVERICERCPTCKQAKAKSQPHGLYTPLPIPSHPWNDISMDFVVGLPRTRTGKDSIFVVVDRFSKMAHFIPCHKTDDAIHIANLFFREVVRLHGMPKTIVSDRDTKFLSYFWKTLWSKLGTKLLFSTTCHPQTDGQTEVVNRTLSTLLRALIKKNLKTWEDCLPHVEFAYNHSMHSASKFSPFQIVYGFNPTTPLDLMPLPLSERVSLDGKKKAELVQQIHEQAKKNIEEKTKQYAKHANKSRKEVIFNEGDLVWIHLRKERFPKERKSKLMSRIDGPFKVLKRINNNAYSLDLQGKYNVSNSFNVADLFPFIADNTDLRSNPFQLGEDDVIMTSLDHGADEIMTSLDHGADEIMTSLDHGDDVIMTSLDHGAKEQFEGGKVINHSIKHAVEDLRELESNDSMDYSTQHEDELLGATKKEAMHVLNGPMTRSKTRLLNQDITTLLQHIEGSLKQDACQTTLVVIQAV

SEQ ID NO: 233 - protein, 1292 aa, Arabidopsis thaliana
MDADAMETETTDQVSASPLHFARSYQVEALEKAIKQNTIVFLETGSGKTLIAIMLLRSYAYLFRKPSPCFCVFLVPQVVLVTQQAEALKMHTDLKVGMYWGDMGVDFWDSSTWKQEVDKYEVLVMTPAILLDALRHSFLSLSMIKVLIVDECHHAGGKHPYACIMREFYHKELNSGTSNVPRIFGMTASLVYTCENESVLAGFVPFSTPSFKYYQHIKIPSPKRASLVEKLERLTIKHRLSLGTLDLNSSTVDSVEKRLLRISSTLTYCLDDLGILLAQKAAQSLSASQNDSFLWGELNMFSVALVKKFCSDASQEFLAEIPQGLNWSVANINGNAEAGLLTLKTVCLIETLLGYSSLENIRCIIFVDRVITAIVLESLLAEILPNCNNWKTKYVAGNNSGLQNQTRKKQNEIVEDFRRGLVNIIVATSILEEGLDVQSCNLVIRFDPASNICSFIQSRGRARMQNSDYLMMVERMREESLDHSLVPCPPLPDDSDEPLFRVESTGATVTLSSSVSLIYHYCSRLPSDEYFKPAPRFDVNKDQGSCTLYLPKSCPVKEVKAEANNKVLKQAVCLKACIQLHKVGALSDHLVPDMVVAETVSQKLGTRVVLEDDIGNTSFRLEDHRGTIAVTLSYVGAFHLTQEEVLFCRRFQITLFRVLLDHSVENLMEALNGLHLRDGVALDYLLVPSTHSHETSLIDWEVIRSVNLTSHEVLEKHENCSTNGASRILHTKDGLFCTCVVQNALVYTPHNGYVYCTKGVLNNLNGNSLLTKRNSGDQTYIEYYEERHGIQLNFVDEPLLNGRHIFTLHSYLHMAKKKKEKEHDREFVELPPELCHVILSPISVDMIYSYTFIPSVMQRIESLLIAYNLKKSIPKVNIPTIKVLEAITTKKCEDQFHLESLETLGDSFLKYAVCQQLFQHCHTHHEGLLSTKKDGMISNVMLCQFGCQQKLQGFIRDECFEPKGWMVPGQSSAAYSLVNDTLPESRNIYVASRRNLKRKSVADVVESLIGAYLSEGGELAALMFMNWVGIKVDFTTTKIQRDSPIQAEKLVNVGYMESLLNYSFEDKSLLVEALTHGSYMMPEIPRCYQRLEFLGDSVLDYLITKHLYDKYPCLSPGLLTDMRSASVNNECYALVAVKANLHKHILYASHHLHKHISRTVSEFEQSSLQSTFGWESDISFPKVLGDVIESLAGAIFVDSGYNKEVVFASIKPLLGCMITPETVKLHPVRELTELCQKWQFELSKAKDFDSFTVEVKAKEMSFAHTAKASDKKMAKKLAYKEVLNLLKNSLDY

SEQ ID NO: 234 - protein, 1384 aa, Arabidopsis thaliana
MSSLVERLRIRSDRKPVYNLDDSDDDDFVPKKDRTFEQVEAIVRTDAKENACQACGESTNLVSCNTCTYAFHAKCLVPPLKDASVENWRCPECVSPLNEIDKILDCEMRPTKSSEQGSSDAEPKPIFVKQYLVKWKGLSYLHCSWVPEKEFQKAYKSNHRLKTRVNNFHRQMESFNNSEDDFVAIRPEWTTVDRILACREEDGELEYLVKYKELSYDECYWESESDISTFQNEIQRFKDVNSRTRRSKDVDHKRNPRDFQQFDHTPEFLKGLLHPYQLEGLNFLRFSWSKQTHVILADEMGLGKTIQSIALLASLFEENLIPHLVIAPLSTLRNWEREFATWAPQMNVVMYFGTAQARAVIREHEFYLSKDQKKIKKKKSGQISSESKQKRIKFDVLLTSYEMINLDSAVLKPIKWECMIVDEGHRLKNKDSKLFSSLTQYSSNHRILLTGTPLQNNLDELFMLMHFLDAGKFGSLEEFQEEFKDINQEEQISRLHKMLAPHLLRRVKKDVMKDMPPKKELILRVDLSSLQKEYYKAIFTRNYQVLTKKGGAQISLNNIMMELRKVCCHPYMLEGVEPVIHDANEAFKQLLESCGKLQLLDKMMVKLKEQGHRVLIYTQFQHMLDLLEDYCTHKKWQYERIDGKVGGAERQIRIDRFNAKNSNKFCFLLSTRAGGLGINLATADTVIIYDSDWNPHADLQAMARAHRLGQTNKVMIYRLINRGTIEERMMQLTKKKMVLEHLVVGKLKTQNINQEELDDIIRYGSKELFASEDDEAGKSGKIHYDDAAIDKLLDRDLVEAEEVSVDDEEENGFLKAFKVANFEYIDENEAAALEAQRVAAESKSSAGNSDRASYWEELLKDKFELHQAEELNALGKRKRSRKQLVSIEEDDLAGLEDVSSDGDESYEAESTDGEAAGQGVQTGRRPYRRKGRDNLEPTPLMEGEGRSFRVLGFNQSQRAIFVQTLMRYGAGNFDWKEFVPRLKQKTFEEINEYGILFLKHIAEEIDENSPTFSDGVPKEGLRIEDVLVRIALLILVQEKVKFVEDHPGKPVFPSRILERFPGLRSGKIWKEEHDKIMIRAVLKHGYGRWQAIVDDKELGIQELICKELNFPHISLSAAEQAGLQGQNGSGGSNPGAQTNQNPGSVITGNNNASADGAQVNSMFYYRDMQRRLVEFVKKRVLLLEKAMNYEYAEEYYGLGGSSSIPTEEPEAEPKIADTVGVSFIEVDDEMLDGLPKTDPITSEEIMGAAVDNNQARVEIAQHYNQMCKLLDENARESVQAYVNNQPPSTKVNESFRALKSINGNINTILSITSDQSKSHEDDTKPDLNNVEMKDTAEETKPLRGGVVDLNVVEGEENIAEASGSVDVKMEEAKEEEKPKNMVVD

SEQ ID NO: 235 - protein, 400 aa, Arabidopsis thaliana
MSVHVKEEPVLVPNCDVENTELAVFNGNGESELENFGTCVDEITDRVNQLEQKVVEVEHFYSTKDGAAQTNTSKSNSGGKKIAISQPNNSKGNSAGKEKSKGKHVSSPDLMRQFATMFRQIAQHKWAWPFLEPVDVKGLGLHDYYKVIEKPMDLGTIKKKMESSEYSNVREIYADVRLVFKNAMRYNEEKEDVYVMAESLLEKFEEKWLLIMPKLVEEEKKQVDEEAEKHANKQLTMEAAQAEMARDLSNELYEIDLQLEKLRESVVQRCRVRNRVFGVVLEINRKLSTQEKKGLSAALGRLSPEDLSKALKMVSESNPSFPAGAPEVELDIDVQTDVTLWRLKVFVQEALKAANKSSGGTNAQNNNNTGTGEINKNNAKRRREISDAINKASIKRAKKA

SEQ ID NO: 236 - protein, 794 aa, Arabidopsis thaliana
MVHSESSILSSLRGGDGGGIPCSKDELAINGSYTDPMGRRKSKRFKVAAESEFSPDFGSITRQLRSRRMQKEFTVETYETRNVSDVCVLSSQADVELIPGEIVAERDSFKSVDCNDMSVGLTEGAESLGVNMQEPMKDRNMPENTSEQNMVEVHPPSISLPEEDMMGSVCRKSITGTKELHGRTISVGRDLSPNMGSKFSKNGKTAKRSISVEEENLVLEKSDSGDHLGPSPEVLELEKSEVWIITDKGVVMPSPVKPSEKRNGDYGEGSMRKNSERVALDKKRLASKFRLSNGGLPSCSSSGDSARYKVKETMRLFHETCKKIMQEEEARPRKRDGGNFKVVCEASKILKSKGKNLYSGTQIIGTVPGVEVGDEFQYRMELNLLGIHRPSQSGIDYMKDDGGELVATSIVSSGGYNDVLDNSDVLIYTGQGGNVGKKKNNEPPKDQQLVTGNLALKNSINKKNPVRVIRGIKNTTLQSSVVAKNYVYDGLYLVEEYWEETGSHGKLVFKFKLRRIPGQPELPWKEVAKSKKSEFRDGLCNVDITEGKETLPICAVNNLDDEKPPPFIYTAKMIYPDWCRPIPPKSCGCTNGCSKSKNCACIVKNGGKIPYYDGAIVEIKPLVYECGPHCKCPPSCNMRVSQHGIKIKLEIFKTESRGWGVRSLESIPIGSFICEYAGELLEDKQAESLTGKDEYLFDLGDEDDPFTINAAQKGNIGRFINHSCSPNLYAQDVLYDHEEIRIPHIMFFALDNIPPLQELSYDYNYKIDQVYDSNGNIKKKFCYCGSAECSGRLY

SEQ ID NO: 237 - protein, 2044 aa, Arabidopsis thaliana
MASKGGKSKPDIVMASKSGKSKPDNESRAKRQKTLEAPKEPRRPKTHWDHVLEEMAWLSKDFESERKWKLAQAKKVALRASKGMLDQASREERKLKEEEQRLRKVALNISKDMKKFWMKVEKLVLYKHQLVRNEKKKKAMDKQLEFLLGQTERYSTMLAENLVEPYKQGQNTPSKPLLTIESKSDEERAEQIPPEINSCLESGSPELDEDYDLKSEDETDEKHFTKRERQEELEALQNEVDLPVEELLRRYTSGRVSRETSPVKDENEDNLTSVSRVTSPVKDENQDNLASVGQDHGEDKNNLAASEETEGNPSVRRSNDSYGHLAISETHSHDLEPGMTTASVKSRKEDHTYDFNDEQEDVDFVLANGEEKDDEATLAVEEELAKADNEDHVEEIALLQKESEMPIEVLLARYKEDFGGKDISEDESESSFAVSEDSIVDSDENRQQADLDDDNVDLTECKLDPEPCSENVEGTFHEVAEDNDKDSSDKIADAAAAARSAQPTGFTYSTTKVRTKLPFLLKHSLREYQHIGLDWLVTMYEKKLNGILADEMGLGKTIMTIALLAHLACDKGIWGPHLIVVPTSVMLNWETEFLKWCPAFKILTYFGSAKERKLKRQGWMKLNSFHVCITTYRLVIQDSKMFKRKKWKYLILDEAHLIKNWKSQRWQTLLNFNSKRRILLTGTPLQNDLMELWSLMHFLMPHVFQSHQEFKDWFCNPIAGMVEGQEKINKEVIDRLHNVLRPFLLRRLKRDVEKQLPSKHEHVIFCRLSKRQRNLYEDFIASTETQATLTSGSFFGMISIIMQLRKVCNHPDLFEGRPIVSSFDMAGIDVQLSSTICSLLLESPFSKVDLEALGFLFTHLDFSMTSWEGDEIKAISTPSELIKQRVNLKDDLEAIPLSPKNRKNLQGTNIFEEIRKAVFEERIQESKDRAAAIAWWNSLRCQRKPTYSTSLRTLLTIKGPLDDLKANCSSYMYSSILADIVLSPIERFQKMIELVEAFTFAIPAARVPSPTCWCSKSDSPVFLSPSYKEKVTDLLSPLLSPIRPAIVRRQVYFPDRRLIQFDCGKLQELAMLLRKLKFGGHRALIFTQMTKMLDVLEAFINLYGYTYMRLDGSTPPEERQTLMQRFNTNPKIFLFILSTRSGGVGINLVGADTVIFYDSDWNPAMDQQAQDRCHRIGQTREVHIYRLISESTIEENILKKANQKRVLDNLVIQNGEYNTEFFKKLDPMELFSGHKALTTKDEKETSKHCGADIPLSNADVEAALKQAEDEADYMALKRVEQEEAVDNQEFTEEPVERPEDDELVNEDDIKADEPADQGLVAAGPAKEEMSLLHSDIRDERAVITTSSQEDDTDVLDDVKQMAAAAADAGQAISSFENQLRPIDRYAIRFLELWDPIIVEAAMENEAGFEEKEWELDHIEKYKEEMEAEIDDGEEPLVYEKWDADFATEAYRQQVEVLAQHQLMEDLENEAREREAAEVAEMVLTQNESAHVLKPKKKKKAKKAKYKSLKKGSLAAESKHVKSVVKIEDSTDDDNEEFGYVSSSDSDMVTPLSRMHMKGKKRDLIVDTDEEKTSKKKAKKHKKSLPNSDIKYKQTSALLDELEPSKPSDSMVVDNELKLTNRGKTVGKKFITSMPIKRVLMIKPEKLKKGNLWSRDCVPSPDSWLPQEDAILCAMVHEYGPNWNFVSGTLYGMTAGGAYRGRYRHPAYCCERYRELIQRHILSASDSAVNEKNLNTGSGKALLKVTEENIRTLLNVAAEQPDTEMLLQKHFSCLLSSIWRTSTRTGNDQMLSLNSPIFNRQFMGSVNHTQDLARKPWQGMKVTSLSRKLLESALQDSGPSQPDNTISRSRLQETQPINKLGLELTLEFPRGNDDSLNQFPPMISLSIDGSDSLNYVNEPPGEDVLKGSRVAAENRYRNAANACIEDSFGWASNTFPANDLKSRTGTKAQSLGKHKLSASDSAKSTKSKHRKLLAEQLEGAWVRPNDPNLKFDFTPGDREEEEEQEVDEKANSAEIEMISCSQWYDPFFTSGLDDCSLASDISEIE

SEQ ID NO: 238 - protein, 1499 aa, Arabidopsis thaliana
MVTTRSQEGDGKGKEVELEVPLDSRVTRLETTVAEQHKEMMKQFADLYAVLSRSTAGKMVDEQSTLDRSAPRSSQSMENRSGYPDPYRDARHQQVRSDHFNAYNNLTRLGKIDFPRFDGTRLKEWLFKVEEFFGVDSTPEDMKVKMAAIHFDSHASTWHQSFIQSGVGLEVLYDWKGYVKLLKERFEDDCDDPMAELKHLQETDGIIDYHQKFELIKTRVNLSEEYLVSVYLAGLRTDTQMHVRMFQPQTVRHCLFLGKTYEKAHPKKPANTTWSTNRSAPTGGYNKYQKEGESKTDHYGNKGNFKPVSQQPKKMSQQEMSDRRSKGLCYFCDEKYTPEHYLVHKKTQLFRMDVDEEFEDAREELVNDDDEHMPQISVNAVSGIAGYKTMRVKGTYDKKIIFILIDSGSTHNFLDPNTAAKLGCKVDTAGLTRVSVADGRKLRVEGKVTDFSWKLQTTTFQSDILLIPLQGIDMVLGVQWLETLGRISWEFKKLEMRFKFNNQKVLLHGLTSGSVREVKAQKLQKLQEDQVQLAMLCVQEVSESTEGELCTINALTSELGEESVVEEVLNEYPDIFIEPTALPPFREKHNHKIKLLEGSNPVNQRPYRYSIHQKNEIDKLVEDLLTNGTVQASSSPYASPVVLVKKKDGTWRLCVDYRELNGMTVKDSFPIPLIEDLMDELGGAVIFSKIDLRAGYHQVRMDPDDIQKTAFKTHSGHFEYLVMPFGLTNAPATFQGLMNFIFKPFLRKFVLVFFDDILVYSSSLEEHRQHLKQVFEVMRANKLFAKLSKCAFAVPKVEYLGHFISAQGIETDPAKIKAVKEWPQPTTLKQLRGFLGLAGYYRRFVRSFGVIAGPLHALTKTDAFEWTAVAQQAFEDLKAALCQAPVLSLPLFDKQFVVETDACGQGIGAVLMQEGHPLAYISRQLKGKQLHLSIYEKELLAVIFAVRKWRHYLLQSHFIIKTDQRSLKYLLEQRLNTPIQQQWLPKLLEFDYEIQYRQGKENVVADALSRVEGSEVLHMAMTVVECDLLKDIQAGYANDSQLQDIITALQRDPDSKKYFSWSQNILRRKSKIVVPANDNIKNTILLWLHGSGVGGHSGRDVTHQRVKGLFYWKGMIKDIQAYIRSCGTCQQCKSDPAASPGLLQPLPIPDTIWSEVSMDFIEGLPVSGGKTVIMVVVDRLSKAAHFIALSHPYSALTVAHAYLDNVFKLHGCPTSIVSDRDVVFTSEFWREFFTLQGVALKLTSAYHPQSDGQTEVVNRCLETYLRCMCHDRPQLWSKWLALAEYWYNTNYHSSSRMTPFEIVYGQVPPVHLPYLPGESKVAVVARSLQEREDMLLFLKFHLMRAQHRMKQFADQHRTEREFEIGDYVYVKLQPYRQQSVVMRANQKLSPKYFGPYKIIDRCGEVAYKLALPSYSQVHPVFHVSQLKVLVGNVSTTVHLPSVMQDVFEKVPEKVVERKMVNRQGKAVTKVLVKWSNEPLEEATWEFLFDLQKTFPEFEA

SEQ ID NO: 239 - protein, 130 aa, Arabidopsis thaliana
MAGRGKTLGSGGAKKATSRSSKAGLQFPVGRIARFLKAGKYAERVGAGAPVYLAAVLEYLAAEVLELAGNAARDNKKTRIVPRHIQLAVRNDEELSKLLGDVTIANGGVMPNIHNLLLPKKAGASKPQED

SEQ ID NO: 240 - protein, 2176 aa, Arabidopsis thaliana
MEPTDSTNEQLGDTKTAAVKEESRSFLGIDLNEIPTGATLGGGCTAGQDDDGEYEPVEVVRSIHDNPDPAPGAPAEVPEPDRDASCGACGRPESIELVVVCDACERGFHMSCVNDGVEAAPSADWMCSDCRTGGERSKLWPLGVKSKLILDMNASPPSDAEGYGAEETSDSRKHMLASSSCIGNSFDYAMMHSSFSSLGRGHASLEASGLMSRNTKMSMDALGSHNLGFGFPLNLNNSSLPMRFPSLDPSELFLQNLRHFISERHGVLEDGWRVEFRQPLNGYQLCAVYCAPNGKTFSSIQEVACYLGLAINGNYSCMDAEIRNENSLLQERLHTPKRRKTSRWPNNGFPEQKGSSVSAQLRRFPFNGQTMSPFAVKSGTHFQAGGSLSSGNNGCGCEEAKNGCPMQFEDFFVLSLGRIDIRQSYHNVNVIYPIGYKSCWHDKITGSLFTCEVSDGNSGPIFKVTRSPCSKSFIPAGSTVFSCPKIDEMVEQNSDKLSNRRDSTQERDDDASVEILLSEHCPPLGDDILSCLREKSFSKTVNSLRSEVDSSRVDFDKNLSYDQDHGVEIGDIVVEEDSLSDAWKKVSQKLVDACSIVLKQKGTLNFLCKHVDRETSEINWDTMNEKDNVILSLSKFCCSLAPCSVTCGEKDKSEFAAVVDALSRWLDQNRFGLDADFVQEMIEHMPGAESCTNYRTLKSRSSSSVPITVAEGALVVKPKGGENVKDEVFGEISRKAKKPKLNGGHGVRNLHPPPGRPMCLRLPPGLVGDFLQVSEVFWRFHEILGFEEAFSPENLEQELINPVFDGLFLDKPGKDDKRSEINFTDKDSTATKLFSLFDESRQPFPAKNTSASELKEKKAGDSSDFKISDSSRGSCVGALLTRAHISLLQVLICELQSKVAAFVDPNFDSGESRSRRGRKKDDSTLSAKRNKLHMLPVNEFTWPELARRYILSLLSMDGNLESAEIAARESGKVFRCLQGDGGLLCGSLTGVAGMEADSMLLAEAIKKISGSLTSENDVLSVEDDDSDGLDATETNTCSGDIPEWAQVLEPVKKLPTNVGTRIRKCVYEALERNPPEWAKKILEHSISKEIYKGNASGPTKKAVLSLLADIRGGDLVQRSIKGTKKRTYISVSDVIMKKCRAVLRGVAAADEDKVLCTLLGRKLLNSSDNDDDGLLGSPAMVSRPLDFRTIDLRLAAGAYDGSTEAFLEDVLELWSSIRVMYADQPDCVDLVATLSEKFKSLYEAEVVPLVQKLKDYRKLECLSAEMKKEIKDIVVSVNKLPKAPWDEGVCKVCGVDKDDDSVLLCDTCDAEYHTYCLNPPLIRIPDGNWYCPSCVIAKRMAQEALESYKLVRRRKGRKYQGELTRASMELTAHLADVMEEKDYWEFSAEERILLLKLLCDELLSSSLVHQHLEQCAEAIIEMQQKLRSLSSEWKNAKMRQEFLTAKLAKVEPSILKEVGEPHNSSYFADQMGCDPQPQEGVGDGVTRDDETSSTAYLNKNQGKSPLETDTQPGESHVNFGESKISSPETISSPGRHELPIADTSPLVTDNLPEKDTSETLLKSVGRNHETHSPNSNAVELPTAHDASSQASQELQACQQDLSATSNEIQNLQQSIRSIESQLLKQSIRRDFLGTDASGRLYWGCCFPDENPRILVDGSISLQKPVQADLIGSKVPSPFLHTVDHGRLRLSPWTYYETETEISELVQWLHDDDLKERDLRESILWWKRLRYGDVQKEKKQAQNLSAPVFATGLETKAAMSMEKRYGPCIKLEMETLKKRGKKTKVAEREKLCRCECLESILPSMIHCLICHKTFASDDEFEDHTESKCIPYSLATEEGKDISDSSKAKESLKSDYLNVKSSAGKDVAEISNVSELDSGLIRYQEEESISPYHFEEICSKFVTKDCNRDLVKEIGLISSNGIPTFLPSSSTHLNDSVLISAKSNKPDGGDSGDQVIFAGPETNVEGLNSESNMSFDRSVTDSHGGPLDKPSGLGFGFSEQKNKKSSGSGLKSCCVVPQAALKRVTGKALPGFRFLKTNLLDMDVALPEEALRPSKSHPNRRRAWRVFVKSSQSIYELVQATIVVEDMIKTEYLKNEWWYWSSLSAAAKISTLSALSVRIFSLDAAIIYDKPITPSNPIDETKPIISLPDQKSQPVSDSQERSSRVRRSGKKRKEPEGS

SEQ ID NO: 241 - protein, 396 aa, Arabidopsis thaliana
MVLLSFSLRFIAFTLTITLTQIADGFQSRMLMNNGLALSPQMGWNSWNHFQCNINETLIKQTADAMVSSGLSAIGYKYINIDDCWGELKRDSQGSLVAKASTFPSGIKALSDYVHSKGLKLGIYSDAGTLTCSQTMPGSLGHEEQDAKTFASWGIDYLKYDNCENTGTSPRERYPKMSKALLNSGRSIFFSLCEWGQEDPATWAGDIGNSWRTTGDIQDNWKSMTLIADQNDRWASYARPGSWNDPDMLEVGNGGMTKEEYMSHFSIWALAKAPLLIGCDLRSMDKVTFELLSNKEVIAVNQDKLGIQGKKVKKEGDLEVWAGPLSKKRVAVILWNRGSASANITARWAEIGLNSSDIVNARDLWEHSTYSCVKKQLSALVEPHACKMYTLTRRKA

SEQ ID NO: 242 - protein, 1090 aa, Arabidopsis thaliana
MAENTASHRRKPRSLNDRHYSILQDLSAPPRQPPSSSHGEDEETKKSMIKLAGRRRLCKALPKEDEADGYDDPDLVDFYSPVKGETSLDSAGIGNKFTSWDESKEANTELAGEPNFSIITDFCSPSPQLKQKEEMQGDGGRNEIMGILDDLTSKLGTMSIQKKKDSQSNDFDACGVKSQVDKFDFEDAKSSFSLLSDLSKSSPDVVTTYNAGVNSIKDKQGKSGFAIREEQTSKEFSREWEERISNVGKQNSYSGRHFDDNSEDNRQGYNLDRGKSQCKEVDQSMKTTRHIEVSEKIRTVGRSNAAKLRDLDEDDDDDDCLILSGKKAAEMKINKPARSYNAKRHGYDERSLEDEGSITLTGLNLSYTLPGKIATMLYPHQREGLNWLWSLHTQGKGGILGDDMGLGKTMQICSFLAGLFHSKLIKRALVVAPKTLLPHWMKELATVGLSQMTREYYGTSTKAREYDLHHILQGKGILLTTYDIVRNNTKALQGDDHYTDEDDEDGNKWDYMILDEGHLIKNPNTQRAKSLLEIPSSHRIIISGTPIQNNLKELWALFNFSCPGLLGDKNWFKQNYEHYILRGTDKNATDREQRIGSTVAKNLREHIQPFFLRRLKSEVFGDDGATSKLSKKDEIVVWLRLTACQRQLYEAFLNSEIVLSAFDGSPLAALTILKKICDHPLLLTKRAAEDVLEGMDSTLTQEEAGVAERLAMHIADNVDTDDFQTKNDSISCKLSFIMSLLENLIPEGHRVLIFSQTRKMLNLIQDSLTSNGYSFLRIDGTTKAPDRLKTVEEFQEGHVAPIFLLTSQVGGLGLTLTKADRVIVVDPAWNPSTDNQSVDRAYRIGQTKDVIVYRLMTSATVEEKIYRKQVYKGGLFKTATEHKEQIRYFSQQDLRELFSLPKGGFDVSPTQQQLYEEHYNQIKLDEKLESHVKFLETLGIAGVSHHSLLFSKTAPIQAIQKDEEEQIRRETALLLGRASASISQDTVINGADYAFKPKDVNLDKRINISPVDDKELSESVIKARLNRLTMLLQNKGTVSRLPDGGAKIQKQIAELTRELKDMKAAERINMPQVIDLEEDISRKMQKGLNL

SEQ ID NO: 243 - protein, 1607 aa, Arabidopsis thaliana
MDWIHKSTPFMEPSNLAKLVQGNVPLQPHDSHSSLTDLDMDLREVYFLILHFLSIGPCERTFGHLRDEILEKGLLPRRYHSWWSRSGIYSGRADDDGISLPLSYDNLIERYPHIEKDHLVKLLKQLILNPSFPSHMRVEGNAPNAADVPTLLGSGTFSLVDRSNSYSSTLSNMFLWIWDLKKSHICIEPDSGSKALHFRNLFFWLWQSLLGIMTCIGNSGEVAHIGEVKSRGNNIESQKARHVASYLRWPHMHADQVRGLSLREIGGGFRKHHRAPSILSACHAIAKPSTMVQKMQNIKKLRGHRNAVYCAIFDRSGRYVITGSDDRLVKIWSMETALCLASCRGHEGDITDLAVSSNNALVASASNDFVIRVWRLPDGMPISVLRGHTGAVTAIAFSPRQASVYQLLSSSDDGTCRIWDARYSQWLPRIYVPSPSDANTGSLEVSLLGESTFTSSNTGSTSNASQSHQILCCAYNANGTIFVTGSSDSNARVWSASKPNLDDAEQPTHELDVLRGHENDVNYVQFSGCAVAPKSSTADALKEDSYPKFKNSWFCHDNIVTCSRDGSAIIWTPRSRKFHGKSGRWMKGYHLKVPPPPLPPQPPRGGPRQRFLPTPRGVNMIIWSLDNRFVLAAIMDCRICVWNAADGSLVHCLTGHSESSYVLDVHPFNPRIAMSAGYDGKTIIWDIWEGIPIKVYEIGRFKLVDGKFSQDGTSIVLSDDVGQIYFLNTGQGESQKNAKYDQFFLGDYRPLIRDTNGHVLDQETQLLPHRRNLQDLLCDSSMIPYPEPDQTMFQQRRLGALGVEWRPSSIKFSVGPDFSLGQDYIMPPLADLDRLIEPLPEFIDAMYWEPEHEVLSDDNDSEYNAEVSSDGARASPCSNSSNELECSSEDSDVENIHESSYHWKRRRKHPKVNVSTSSGRRDKRILDENDSSNSGIKRTKNRRIVVKASKRKHSDVKASRPQRAAAQNARSLLSKISGSSSDEVDDDNDSSNSESDRSIPTLRQLDKPSQMLESLSNDKQKKRLIVKISVKKPAESMGSKGDVINQADLEQLSSKPLEENHRVIGIYSREPGSSSVDAKGDSGCQSIPYSMNTPQREKADNQLIRSSDQDQNMCKWREEIPVCEPTELTAPENIEEAQPFYGDEADEILPKKVRRLRLKLRHPNSPRKLEPDEVADDLADGGDGFASIAPSFMNPIMDSEPVIDSVRDSSAHNFEFGEATADVIRRKRSIRSESSTRNSALRIRLGSGSVDKIKKQGIPSTSVYDDASLEEWPSTSKAGSRSRSASVSKPSLHTGIRLNSVSGKISWLLLSEHEEGCRYIPQLGDEVIYFKQGHQEFLKTKELNDRDRSRYLPRNLGAVEICKVEKLNYDTYPGSGDSCCKMTLRVLDSSSSHASRKEFQLTLPELINFPDFIVEKTRYDAAIQTNWKIGNECRVWWRDATGEGGAWWEGRIESSQVKSTDFPESPWERYRVVYETGETSLHSPWEFDNPEFPWEKSTIEDERREKLLSLFAGLVKSISKHQDSYGIQKLNEAAQKMDFCNRFPVPLYPELIHERLENQYYRSIESFKHDVDAMLSNAELYFVRSAHMLSKIKRLRDKLTKTLRKLI

SEQ ID NO: 244 - protein, 914 aa, Arabidopsis thaliana
MVGLEDDTERERSPVVENGFSNGSRSSSSSAGVLSPSRKVTQGNDTLSYANILRARNKFADALALYEAMLEKDSKNVEAHIGKGICLQTQNKGNLAFDCFSEAIRLDPHNACALTHCGILHKEEGRLVEAAESYQKALMADASYKPAAECLAIVLTDLGTSLKLAGNTQEGIQKYYEALKIDPHYAPAYYNLGVVYSEMMQYDNALSCYEKAALERPMYAEAYCNMGVIYKNRGDLEMAITCYERCLAVSPNFEIAKNNMAIALTDLGTKVKLEGDVTQGVAYYKKALYYNWHYADAMYNLGVAYGEMLKFDMAIVFYELAFHFNPHCAEACNNLGVLYKDRDNLDKAVECYQMALSIKPNFAQSLNNLGVVYTVQGKMDAAASMIEKAILANPTYAEAFNNLGVLYRDAGNITMAIDAYEECLKIDPDSRNAGQNRLLAMNYINEGLDDKLFEAHRDWGWRFTRLHPQYTSWDNLKDPERPITIGYISPDFFTHSVSYFIEAPLTHHDYTKYKVVVYSAVVKADAKTYRFRDKVLKKGGVWKDIYGIDEKKIASMVREDKIDILVELTGHTANNKLGTMACRPAPVQVTWIGYPNTTGLPTVDYRITDSLADPPDTKQKQVEELVRLPDCFLCYTPSPEAGPVCPTPALSNGFVTFGSFNNLAKITPKVLQVWARILCAVPNSRLVVKCKPFCCDSIRQRFLTTLEQLGLESKRVDLLPLILFNHDHMQAYSLMDISLDTFPYAGTTTTCESLYMGVPCVTMAGSVHAHNVGVSLLTKVGLGHLVAKNEDEYVQLSVDLASDVTALSKLRMSLRDLMAGSPVCNGPSFAVGLESAYRNMWKKYCKGEVPSLRRMEMLQKEVHDDPLISKDLGPSRVSVTGEATPSLKANGSAPVPSSLPTQSPQLSKRMDSTS

SEQ ID NO: 245 - protein, 1173 aa, Arabidopsis thaliana
MASSSSSERWIDGLQFSSLLWPPPRDPQQHKDQVVAYVEYFGQFTSEQFPDDIAELVRHQYPSTEKRLLDDVLAMFVLHHPEHGHAVILPIISCLIDGSLVYSKEAHPFASFISLVCPSSENDYSEQWALACGEILRILTHYNRPIYKTEQQNGDTERNCLSKATTSGSPTSEPKAGSPTQHERKPLRPLSPWISDILLAAPLGIRSDYFRWCSGVMGKYAAGELKPPTIASRGSGKHPQLMPSTPRWAVANGAGVILSVCDDEVARYETATLTAVAVPALLLPPPTTSLDEHLVAGLPALEPYARLFHRYYAIATPSATQRLLLGLLEAPPSWAPDALDAAVQLVELLRAAEDYASGVRLPRNWMHLHFLRAIGIAMSMRAGVAADAAAALLFRILSQPALLFPPLSQVEGVEIQHAPIGGYSSNYRKQIEVPAAEATIEATAQGIASMLCAHGPEVEWRICTIWEAAYGLIPLNSSAVDLPEIIVATPLQPPILSWNLYIPLLKVLEYLPRGSPSEACLMKIFVATVETILSRTFPPESSRELTRKARSSFTTRSATKNLAMSELRAMVHALFLESCAGVELASRLLFVVLTVCVSHEAQSSGSKRPRSEYASTTENIEANQPVSNNQTANRKSRNVKGQGPVAAFDSYVLAAVCALACEVQLYPMISGGGNFSNSAVAGTITKPVKINGSSKEYGAGIDSAISHTRRILAILEALFSLKPSSVGTPWSYSSSEIVAAAMVAAHISELFRRSKALTHALSGLMRCKWDKEIHKRASSLYNLIDVHSKVVASIVDKAEPLEAYLKNTPVQKDSVTCLNWKQENTCASTTCFDTAVTSASRTEMNPRGNHKYARHSDEGSGRPSEKGIKDFLLDASDLANFLTADRLAGFYCGTQKLLRSVLAEKPELSFSVVSLLWHKLIAAPEIQPTAESTSAQQGWRQVVDALCNVVSATPAKAAAAVVLQAERELQPWIAKDDEEGQKMWKINQRIVKVLVELMRNHDRPESLVILASASDLLLRATDGMLVDGEACTLPQLELLEATARAIQPVLAWGPSGLAVVDGLSNLLKCRLPATIRCLSHPSAHVRALSTSVLRDIMNQSSIPIKVTPKLPTTEKNGMNSPSYRFFNAASIDWKADIQNCLNWEAHSLLSTTMPTQFLDTAARELGCTISLSQ

SEQ ID NO: 246 - protein, 1029 aa, Arabidopsis thaliana
MGTKVSDDLVSTVRSVVGSDYSDMDIIRALHMANHDPTAAINIIFDTPSFAKPDVATPTPSGSNGGKRVDSGLKGCTFGDSGSVGANHRVEEENESVNGGGEESVSGNEWWFVGCSELAGLSTCKGRKLKSGDELVFTFPHSKGLKPETTPGKRGFGRGRPALRGASDIVRFSTKDSGEIGRIPNEWARCLLPLVRDKKIRIEGSCKSAPEALSIMDTILLSVSVYINSSMFQKHSATSFKTASNTAEESMFHPLPNLFRLLGLIPFKKAEFTPEDFYSKKRPLSSKDGSAIPTSLLQLNKVKNMNQDANGDENEQCISDGDLDNIVGVGDSSGLKEMETPHTLLCELRPYQKQALHWMTQLEKGNCTDEAATMLHPCWEAYCLADKRELVVYLNSFTGDATIHFPSTLQMARGGILADAMGLGKTVMTISLLLAHSWKAASTGFLCPNYEGDKVISSSVDDLTSPPVKATKFLGFDKRLLEQKSVLQNGGNLIVCPMTLLGQWKTEIEMHAKPGSLSVYVHYGQSRPKDAKLLSQSDVVITTYGVLTSEFSQENSADHEGIYAVRWFRIVLDEAHTIKNSKSQISLAAAALVADRRWCLTGTPIQNNLEDLYSLLRFLRIEPWGTWAWWNKLVQKPFEEGDERGLKLVQSILKPIMLRRTKSSTDREGRPILVLPPADARVIYCELSESERDFYDALFKRSKVKFDQFVEQGKVLHNYASILELLLRLRQCCDHPFLVMSRGDTAEYSDLNKLSKRFLSGKSSGLEREGKDVPSEAFVQEVVEELRKGEQGECPICLEALEDAVLTPCAHRLCRECLLASWRNSTSGLCPVCRNTVSKQELITAPTESRFQVDVEKNWVESSKITALLEELEGLRSSGSKSILFSQWTAFLDLLQIPLSRNNFSFVRLDGTLSQQQREKVLKEFSEDGSILVLLMSLKAGGVGINLTAASNAFVMDPWWNPAVEEQAVMRIHRIGQTKEVKIRRFIVKGTVEERMEAVQARKQRMISGALTDQEVRSARIEELKMLFT

SEQ ID NO: 247 - protein, 650 aa, Arabidopsis thaliana
MGSSHIPLDPSLNPSPSLIPKLEPVTESTQNLAFQLPNTNPQALISSAVSDFNEATDFSSDYNTVAESARSAFAQRLQRHDDVAVLDSLTGAIVPVEENPEPEPNPYSTSDSSPSVATQRPRPQPRSSELVRITDVGPESERQFREHVRKTRMIYDSLRMFLMMEEAKRNGVGGRRARADGKAGKAGSMMRDCMLWMNRDKRIVGSIPGVQVGDIFFFRFELCVMGLHGHPQSGIDFLTGSLSSNGEPIATSVIVSGGYEDDDDQGDVIMYTGQGGQDRLGRQAEHQRLEGGNLAMERSMYYGIEVRVIRGLKYENEVSSRVYVYDGLFRIVDSWFDVGKSGFGVFKYRLERIEGQAEMGSSVLKFARTLKTNPLSVRPRGYINFDISNGKENVPVYLFNDIDSDQEPLYYEYLAQTSFPPGLFVQQSGNASGCDCVNGCGSGCLCEAKNSGEIAYDYNGTLIRQKPLIHECGSACQCPPSCRNRVTQKGLRNRLEVFRSLETGWGVRSLDVLHAGAFICEYAGVALTREQANILTMNGDTLVYPARFSSARWEDWGDLSQVLADFERPSYPDIPPVDFAMDVSKMRNVACYISHSTDPNVIVQFVLHDHNSLMFPRVMLFAAENIPPMTELSLDYGVVDDWNAKLAICN

SEQ ID NO: 248 - protein, 552 aa, Arabidopsis thaliana
MVVETIERSCEGSKRRHVNGGDIAVPCSGEECSNGDINVAPGVSAKRARVSREMTFEDIYGADALLNDDDDEDDDCDWEPVQAPMEFVKWCCVNCTMSNPGDMVHCCICGEHKESGILRHGYLASPFFKDTGLIEVEEKYGGSSSATSSTAVGFDERMLLHSEFEVKAQPHPERPDRLRAIAASLATAGVFPGRCLPINAREITKQELQMVHTSEHVDAVDTTSQLLYSYFTSDTYANEYSARAARLAAGLCADLATDIFTGRVKNGFALVRPPGHHAGVRHAMGFCLHNNAAVAALVAQAAGAKKVLIVDWDVHHGNGTQEIFEQNKSVLYISLHRHEGGNFYPGTGAADEVGSNGGEGYCVNVPWSCGGVGDKDYIFAFQHVVLPIASAFSPDFVIISAGFDAARGDPLGCCDVTPAGYSRMTQMLGDLCGGKMLVILEGGYNLRSISASATAVIKVLLGENPENELPIATTPSVAGLQTVLDVLNIQLEFWPSLAISYSKLLSELEARLIENKKNQMKRKVVRVPTWWKWGRKKLLYNFLSARMISRSK

SEQ ID NO: 249 - protein, 251 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGGGWEGGEQNVTYAHHQAQSQGLYQPLECNPTLQMGYDNPVCSEQITATTQAQAQQGNGYIPGWML

SEQ ID NO: 250 - protein, 313 aa, Arabidopsis thaliana
MVLSQKLHEAFKGTVERITGPRTISAFKEKGVLSVSEFVLAGDNLVSKCPTWSWESGDASKRKPYLPSDKQFLITRNVPCLRRAASVAEDYEAAGGEVLVDDEDNDGWLATHGKPKDKGKEEDNLPSMDALDINEKNTIQSIPTYFGGEEDDDIPDMEEFDEADNVVENDPATLQSTYLVAHEPDDDNILRTRTYDLSITYDKYYQTPRVWLTGYDESRMLLQPELVMEDVSQDHARKTVTIEDHPHLPGKHASVHPCRHGAVMKKIIDVLMSRGVEPEVDKYLFLFLKFMASVIPTIEYDYTMDFDLGSSST

SEQ ID NO: 251 - DNA, 20 bp, Sicyos angulatus
tgacagaagagagtgagcac

SEQ ID NO: 252 - DNA, 21 bp, Sicyos angulatus
tttggattgaagggagctcta

SEQ ID NO: 253 - DNA, 23 bp, Sicyos angulatus
aatttggattgaagggagctcta

SEQ ID NO: 254 - DNA, 21 bp, Cucurbita moschata
tttggattgaagggagcttta

SEQ ID NO: 255 - DNA, 20 bp, Sicyos angulatus
ttggactgaagggagctccc

SEQ ID NO: 256 - DNA, 20 bp, Sicyos angulatus
atggactgaagggagctccc

SEQ ID NO: 257 - DNA, 21 bp, Cucumis sativus
tcgataaacctctgcatccag

SEQ ID NO: 258 - DNA, 22 bp, Sicyos angulatus
tgaagctgccagcatgatctga

SEQ ID NO: 259 - DNA, 23 bp, Sicyos angulatus
aatgaagctgccagcatgatctg

SEQ ID NO: 260 - DNA, 21 bp, Sicyos angulatus
taaagctgccagcatgatctg

SEQ ID NO: 261 - DNA, 22 bp, Sicyos angulatus
tcaagctgccagcatgatctga

SEQ ID NO: 262 - DNA, 21 bp, Cucurbita moschata
taagccaaggatgaattgccg

SEQ ID NO: 263 - DNA, 21 bp, Sicyos angulatus
agaatcttgatgatgctgcag

SEQ ID NO: 264 - DNA, 20 bp, Arabidopsis thaliana
ttggactgaagggagctccc

SEQ ID NO: 265 - DNA, 20 bp, Arabidopsis thaliana
ttggactgaagggagctccc

SEQ ID NO: 266 - DNA, 20 bp, Arabidopsis thaliana
tgacagaagagagtgagcac

SEQ ID NO: 267 - DNA, 21 bp, Arabidopsis thaliana
tgaagctgccagcatgatcta

SEQ ID NO: 268 - DNA, 20 bp, Arabidopsis thaliana
ttggattgaagggagctcta

SEQ ID NO: 269 - DNA, 21 bp, Arabidopsis thaliana
cagccaaggatgacttgccga

SEQ ID NO: 270 - DNA, 21 bp, Arabidopsis thaliana
tcgataaacctctgcatccag

SEQ ID NO: 271 - DNA, 1097 bp, Cucumis sativus
gataattatttcacattgacccaccatccccaaaatctctcttcattaacttcttttcttccatttccctttcactttgacccatcattcccacctcttctctagaattttaataatcccattaaatatttaattctacatctctctagatttgcatactcttgtccccttctaaccctcttctctctctaaaacagtgcaaatttcagcttttttattttcttttcttttttaagattttgtcatgtagctttctttaaatccacaacccatatcctgatttctctccaagtaaggggagtaattttttaattgttgttgcagttttttctttgtttcctttggagttgctgcttaaagtttcttactttctttctttctgagctttgaaccaaaatcccaacaatggagaaagcccttcattatcttcttcctcttcagcttcagcttctgtttgtcttccttcttcttcgaaaacggtgtcgttccttgtctcctttgtaactctcaaaaccctgtttttgtttcttctcttcttcttacacatttgccttaatctcttggatccacatttctacttctactttcagagaaagtgaattattaatctgtgcaaatggagcaatatgaaatattagagcaaatagggaagggatcctttggttctgcccttcttgtgagacataagcatgaaaagaagaagtatgtgttgaaaaaaattcgtcttgctcgtcagaccgataggtcccgtagatctgctcaccaggagatggagctcatttctaaactacgaaatccatttattgtggagtataaagattcatgggtcgagaagggttgctatgtgtgcattattataggttattgtgaaggaggggacatggctgaagcgataaaaaaagctaacagtattcatttccccgaagagaaactgtgcaagtggttagttcaacttctgatggcactcgattacttgcacatgaatcatatccttcaccgagatgttaagtgttcaaatatatttttgactaaagatcgagatatacgccttggtgacttcggactagccaaaatgttgacgtcagacgatcttgcct

SEQ ID NO: 272 - DNA, 637 bp, Cucurbita maxima
aatccacccagaatgtttaatcgctgaatgattttgatctctttttgggactcgccttttgatttcccctaactctcagtaattgcttcattcacttgatgatttagcgttagcctttagtggagcagttcaagatctgaaaatcgcttgggggtttcgattgattctcgaattgggtttatttaatcactcgggttgaggagattttagggtatggaatctcgtatggatcattacgagataatggagcagatcgggcgtggggcttttggagccgccattcttgtttatcacaaatccgaaaagaagaagtacgtattgaagaagatcaggctcgcgcggcagaccgagcgatgtcgaagatctgctcatcaagagatggcgctgatagccagagttcaacatccttatatagttgagtttaaagaagcttgggttgagaagggctgctacgtttgtattgtgactggatactgtgaaggtggagatatggcagagctaatgaaaaagtcaaatgggttgcactttcctgaagagaaactatgcaagtggtttacacagcttttgttggcggttgagtacctgcattcaaactttgttctacatcgggaccttaaatgttccaacatctttctca

SEQ ID NO: 273 - DNA, 564 bp, Cucumis sativus
aatgctgtctcatcagctattgttactgtaccgatggttggtcgtgatggtatgatgcctgaacaatgggttcaagacgaacgggagctaaaaagacagaagaggaagcagtctaaccgagagtctgccaggagatcaagattacgcaagcaggcggagtgtgaagaactacaagcgagagtgcagacattgaacaacgaaaaccgtactctcagggacgagttacaaaggctctccgaggaatgtgaaaagctaacatcagagaatagttccatcaaggaagaattgacacgattttgtgggccagaggcattagctaacttcgaaaaaggaaacgctgcaccacctgctcaatctcgaggcggcgaaggcaaagattaagaacatcaattccacaacattcaaaagcgatggactctggactggggaagagaaagaccatattaacttaaatttatgatcttgttgtaggaatatagaaatttatttttctgactagatatacgcttgaccctgtttcaacaactgtaacattataaaaagaaaaatttctcaaaaaaaaaa

SEQ ID NO: 274 - DNA, 685 bp, Cucumis sativus
  misc_feature (1)...(685): n = A,T,C or G
aggaatggtcaggatttcaggcatattctccaatacctccacctggatatttggcaacgagcccccaagcacacccgtatatgtggggggtacagcctattatgcccccttacggaactcctccacatccatatgttgcaatgtatcctcatggtggcatatatgctcatccacctatgcctgctggatcgtatccttacagtccttttgctattgcttctccaaatggcattgctgaggcttctgggaatacaccaagcaacatggaaggggaaggtaaaccatctgagctgaaagaaaaattgccaattaaaagatcgaaaggaagtctgggaagtttaagcatgataactgggaagaacaatgagcttggtaaaccatcaggaacgtctgctaatggagtttattctaaaagtgctgaaagtgaaagtgaaggcacgagtgaaagaagtgatgctgactctgaaaacgattcacaactaaaatctggttctgggaaagattctttagaaggtggagggactcctaatggtttaatgcatggttctcagaatgaaggacatagtcttgcacatccattggtgaaccaaacgatgtccataatacctatccaagcttctggagctgttacaggtcctgctacaaatntgaatataggaatggattattggggtaccccaacaac

SEQ ID NO: 275 - DNA, 1009 bp, Cucumis sativus
ggaagacaacaatggtagtttggctcttgggatgttcatgggaaatcagataactgagaacaaaaatatggtttctaatcagaatcaaaatccagtgtttttagggacaggagttgtaaggtcttctcagccgcagcagcaacagcagccactttttcccaaaccagctaatgtgacctttgcttcttcaatgaatttagtgaacaatccccagcttaccaatggatctgggactaatttggttgtggccccaaaacctcctttgcatgatgcattaattcaaggcacgggcattggtgcgatcggcttaggcacgagaggtgtaactgttgcttcaagatctcctacaagtacaatatcatctgatgtgattacaaaatccagcattgaggcgtcttcattttcacccgttccattttcatttggccggggtcggcgaagcagtggagctctggagaaagtggtcgagaggagacaacgaagaatgataaagaacagagagtcagctgcaagatcacgggctcgtaaacaggcttacaccttggaacttgaagcagaagttgcaaaactcaaagaaatgaaccaagagttgcagaagaaacagagagagataatggagacacagaaaaatcaggttttggagaagatgaaatatcagttgggcggcaaaagattctgcttgagaagaacactgactggcccatggtagaggtgccatgatgagttgtcaaatttagttatagtgtctgaaaccagcacagaagcagtgtgtaaaaaaaggcttagactgtgtgtttctaatctgatttcaagtttagagatagattggtagctgtagataacgaagttcgagtaccggtatgtagatagcttacagaaagcagagttgagctatatgttgtataaatgatccttctgtattctaatggttgtttgcttggatctttgacctctgtatcatcaaaatggttgtttatagtttgcctaaccatttcctctaaaaaaaaaa

SEQ ID NO: 276 - DNA, 685 bp, Cucurbita maxima
gggggacgcgtgttcatccatccactttcctttcctttcctttcatcttccttttcctctgcacgaatcctttcctccaatctttcaacctttccgccatgtccatggaccttgaattccctgaaaatctccctaaaatccgccttcctttacaggttcgatcgcctcccaagccttcaaattccatcaacatcccttcctccgtctccgatcacgacagcgccgaccttgaccaccgcggctgccggacgccgacctctgccgagcacaagattccgaagatcatcagctgtcctggagcgccgaggaagccgaagcgccctcccgtaccttgcaagaggaagttgaccatggagctcaaattctttgagttcgtgaatcaagaagaagtcgataatttcttccgatccgcttacgatctcgaagcttcttccgcggcgccgccgaagaggagctgctgccggtcagcctgataatccagattgtcggtttgagccctaaattactacaccgattatagaaaatcaatttttctttaattcttttcttttctttcttccccctttcctttccctccgatagcgagtcagctcttgatgtgtattattattacacgtacataccacatggaatcgaatcgaatcgaatgcaagtcctctttgcatcatcatcggagatagataat

SEQ ID NO: 277 - DNA, 704 bp, Cucurbita maxima
agcagcctggtgaagtcacaagtctccaatatctcatcccctccaatttatctccatatgctactcactttcccatggctcagaacaacttatctacaatgcaacttaacgaactctccaatcctctatataacttccaaggttcttctcagttccaagattttaatcgacatccatgcttgagtagcaattcaacttctgatgaagcagatgagcaacagcaaagcctcattgacgagaggaagcagagaaggatggtctccaatagagagtcggcacgccggtcacgtatgcgcaaacagaagcatttggacgagctttggtctcaagtggtttggcttcggaatgagaaccatcagcttatagataagttgaaccaagtttcagactgccatgacaaggttgttcaagaaaatgctcaactcaaagagcagacttctgaactccgtcaaatgatcacagaactacaggtcaataatccttaccccaaattcagagaacttgaagaaatcccccccaacacaccatccgagagctgagtctgcaccaagataagccagggtgaggaggaaattttttccagtccctgtctccatatatggttcttctgtcttcagtcttttcctccggtcagtctgtaacatcatgcacgtaaagaagaaactgcataactactgtttgagcattttcgttgattaatgctt

SEQ ID NO: 278 - DNA, 718 bp, Cucurbita maxima
gctcttcctctctctccgccgcaatgaagcagaaatccaccatctcctccgccctccaccgccgcctatttcctatcaccctcccacgaaataatcatgaagcgtagcgcctccgagttggccctcgaagagttcctcaaaaaggccgccgtcatctctccccaagtcaccgacgccgacgccgacgccgacgacgacgttttcaatctcgaacgcgaggaagaagtcatcagaagccctaaaagaggcaaaaacttcccggactccgcctgcttcttcggcgatattgatttcagttatttcctcgtcaaaaataatcgggagataatggacgccattgttaaccgtggagctgggctgacggaggctaccatagattcccagtcttctattgtgagcagcccgacatctggtagtaatttgatgggcagagagcgcgggagaggcaacaatagcgggtcctctgaagatcagtccgacgatgaaattgaagctggctcttatgaacaaagcactgacccgcttgcttccaagaaaataagaagaatgatctcgaacagggaatccgctagaagatcgagacgaagaaaacaagctcagttgagtgaactcgagagccaggtgaaacagctgaaaggagaaaatgaaacgttgttcaaccagcttttagatgctagtcagcattaccatgatgccaatactaataatcgggtgctta

SEQ ID NO: 279 - DNA, 630 bp, Cucurbita maxima
gcggaacccaaaggtccagtccagccagctgaacaccgtgggcaaacgtcgagtggttttcaatttggcttgcaagctccggggcaagtggctctaggctctgatcgtggcacttcaacaaaagaaagtgacgctaatggtagtccacttgggatcccatccttacctgcaatgcctaagaaacaagggctacaaactgcccaaacaacaagtggatcgtccagagatgagtctgatgatgatgatcttgaaggagacattgaaaacagtgagaatatgcatccttccgatgcaagacgcgctaggaggatgttgtcaaatagagaatcagcaagacgctccagacgaagaaaacaagcacacttgaacgaccttgagacccaggttggtcaacttagggttgatcactctactttgttaaagtgtctcacggatgtaaatcaaaagtacgatgatgcagctgttgacaatagaattttgaaagctgatatcgagactttaagagcgaaggtgaaaatgtctgaagaaacagtgaaaagattgacaggagtgaacccactgcttgttgccatgtctcagagccaaatgccatttgtgagtagccaaatgccaatgcaatccaactcccaa

SEQ ID NO: 280 - DNA, 707 bp, Cucurbita maxima
  misc_feature (1)...(707): n = A,T,C or G
gatttgtgatttgtagttcttctctctgtttgtccgttccttgattcatttcccctgctccgtgtttgtctctcttgctctgatttcaaaatccatggtttactacttccttctagggttttcctgattacctcgatgattttaggttttctatgacgttctctttactgaggcgacgtattcgtatcctccactcgttttcggttgtgtttctgtactggttctacgtcttctcatgaactaatcgccttcttcgtcgctgtggaatttgattgatctcttcttgcggtagcctgagttgtagatcgggagattcatttgatttttatcagattagatactaaaacaactttttactcgagattacttggtattattttggcgggaagtaattgaaagagagaattatatggcatctattccaaggaaaagctcccccggatcaaatggaggttcgcaacctgccattcctgatgagagaaagcggaagcggatgcaatccaacagagaatcggctcggagatctcggatgaaaaagcagaagcaagtggaagacctcacgggggagctgagccgattacaaatggcgaataatcagcttctgcagagcattggtgccaaggagcaagcatttgttcangtcgacaacatgaacaatgttctcaggtctcaagctatagaactggccgatcgtctgcgatccctga

SEQ ID NO: 281 - DNA, 718 bp, Cucurbita maxima; identical to SEQ ID NO: 278

SEQ ID NO: 282 - DNA, 692 bp, Sicyos angulatus
ttcgtcggcgcaggcgcttccagtggtggcgccgccctcgtcctccgccgcagtctccatcggaggtcggaaaccgacacactctcgccttcacacacagcgtttctagggtttcgccctgccggaattggccgccgagattggatttggatttcgagaggtccagaatccacaattctcagccgttgatcttccggttcttccatctggacttccacatcagctccttgcgccatggaagcaggttggtcgtagaagttatcaagtattcaggactgtcattcggaaattgttgaattgtagtgatttcagctttggttgatggggacaggagaagagggcacgccttctaaaacttcaaaacctcccccctcatctcagcccgtacaggaaatacccccgacactttcatatcctgattggacaagctcaatgcaggcatattatggtgctggtgccactccacctccctactttgcatcttctccaactccccacccttacatgtggggaggtcagcatcctatgatgcaaccttatgggactccagtaccttatccagctatatatcctcatcctcctgggggagtttatgcccatcccaatatcactgtgactcctggctctgcaccaatcagtgcagaatacgatggaaaaccccctgatggaaaagaaagggcttcaaaaaaatc

SEQ ID NO: 283 - DNA, 698 bp, Sicyos angulatus
ggaagcgcagcgcctccgagctggctcttgaagagctcctggaaaagacgacggtggacgctttgaaagtggaacccgacgaagaagtgtcggttagtcgaagcccgaaaagaagcaaaagctttcaggattctgccgacgcctgcaacttcttccgcgatatcgatttcaatttcttcttcaccaataatccggagataatggacgcaattgttaactgtgggggtgggctggcggagggtcctttatgggcacagaatctcactcctaagctttcgagcatttcagccactatagattcccaatcttcttttgtgagcagcccaacatcaggcagcaatatgatgtccagagagcaccaaagagacaacaacagtggatcctctgaagatcagtctgatgatgaagttgaagaacctggctcttatggccaaaccactgaccctctttctttgaagaaaatgagaagaatgatctcaaatagagactctgctagacgatccagaagacgaaaacaagctcatttagccgaactcgagagccagatgaaccagctaaaagtagaaaatgaaacattgttcaaccagcttttagatgctactcaacaataccgtgatgccaatacaaacaaccgagtgcttaaatcagatgtaaacgcaatgagagcaaaggtaaaattggctgaagatacacttgct

SEQ ID NO: 284 - DNA, 698 bp, Sicyos angulatus; identical to SEQ ID NO: 283

SEQ ID NO: 285 - DNA, 1354 bp, Cucumis sativus
gaaattttccccaactcctcttctcatcatccccccccgctctattttccattccgccatttccaaactctttacttacagatctaatccttcctctctctctctctctctctctctggcaatggcggtcacctcttcccctcgcgaggagtatgtttacatggctaagcttgccgagcaagctgagcgttacgaggagatggtcgagtttatggagaaggtttccgccgctgcagatgacgaggaactcaccgttgaggagcggaatcttctttctgttgcttacaagaatgttattggagcacgtagagcttcttggaggattatttcctccattgaacagaaagaagagagccgagggaatgatgatcatgtctctgtcatccgtggttacagatccaagatcgagactgagctttctaacatttgtgatggcatccttaaacttcttgactctcgtctcatttcctctgctgcttctggtgattccaaggttttttatcttaagatgaagggcgattatcatagataccttgctgaatttaagaccggagctgaaaggaaggaagctgccgaaagtactctcactgcttataaatctgctcaggatattgcaaattctgaacttgctcctactcaccctatacgacttgggctggctttgaacttctcagtgttctattatgagattctgaattcccctgatcgcgcttgcagccttgctaaacaggctttcgatgaagcaattgctgagttggatacactgggcgaggaatcatacaaagatagcactttgatcatgcaacttcttcgtgacaacctcaccctatggacttcagacatgcaggacgatggagatgagattaaagaagcagctcccaaacgtgatgatgaatagtagtgagcatattgattctcgcaagtgcaggattcaacttctcctttacatgttttattctggaggagtgcttgtttggaaatttcgcttttctattgttatctaggtacttcttagccttttatcatcaccacactctggaaaggaaaaacaaaaaacaaaaaaaaacaaaaaaacacccttgtgtgtcttccccccaccagtctgtttttcttttttgaccatcaattccatgtccctgaactgccttatttttctcgaatataaattctacatattatcaagcatcatgtaattgatctacctttcgtcgttcgtctcttacaagagacgataacagatgatccttctcaagtaattatataaaactctctttgatgtctgattcgaatcctgttacatgtggtgttggctattttccactgccaaacaataagaagaaaagaaaaaattgta

SEQ ID NO: 286 - DNA, 1097 bp, Cucumis sativus
gagccccccgcatctctttacctttcacactttgatcctaaaaccaccgttcttcagatctattcttcatttcccttccaatggctgccgctccttctgttcgtgaggagaatgtttacatggctaagcttgccgagcaggctgagcgctacgaggagatggtcgagttcatggagaaggtttccgcttctcttgacaaggaggaactcaccgtcgaggagagaaacctcctttctgtcgcttacaagaacgtcatcggtgctcgtagggcctcctggcgtatcatttcctccatcgaacagaaggaggagagccgaggtaacgatgaccatgtctctgtgatccgtgactacagatccaaaattgagaccgaactctccaatatttgcgatggaatccttaagcttcttgattctagactcattccctccgctgcttccggagattccaaggttttttacctcaaaatgaagggcgattaccatagataccttgccgagttcaaaaccggagccgaacgcaaggaagctgctgaaagcactcttactgcttacaaagccgctcaggatattgcaaattctgagttgcctcctacacatccgatccgacttggattggcacttaacttctctgtattctattatgaaattttgaattcccctgatcgtgcctgcagtcttgcgaaacaggcatttgatgaagctatcgccgagttggatacccttggagaggaatcctacaaagatagtactttgatcatgcagcttcttcgggataatctcactctctggacatcggacatgcaggatgatggagctgatgagattaaagaagctccaccgaagcgtgaggatgaaaagcagtgagattagtggctccccaagtagggttaaaacttctcctttatatgtttttgataggagaagatgcttgctttgcttgttgttgcttatttggtactatccgagttctttctaaaaggctctcatgtcatttgttgccggattgtgatgacccgagctacaaaccttgtttactctcttcttctgattaattattatatatctataatcagtcctttgttttcttaaaaaaaa

SEQ ID NO: 287 - DNA, 852 bp, Cucumis sativus
gcgcaaatcgcttttttcttttctcttggtattatttttcttctactcgccggagttcgataatggccgccgccgtgccggaaaatctgtctcgcgagcaatacgtgtacctagcgaagcttgctgagcaggcggaaagatatgaggagatggttcagttcatgcagaaacttgttcttggttcaacacctggctcagagctatctgttgaggagcgaaatcttctctctgtggcttacaagaacgtgattgggtcacttcgagctgcttggcggattgtttcttccatcgagcaaaaggaggagagtcgtaagaatgaagagcatgttgtgcttgttaaagattatagatcaaaggttgagtctgagctttccgatgtctgcgcgagtattttgcagcttttggactcgaatcttattccatctgcctctgctagtgagtctaaggtcttctacttgaagatgaaaggggattaccataggtatttggcggagtttaaggttggagatgagaggaaagctgctgctgaggatactatgctggcttatagggctgctcaggacgtcgcagttgcggatcttgctcccactcatccgataaggctggggctggcactcaatttctctgtgttttacttcgagattctgaatcagtccgataaagcatgtagcatggccaaggaggcatttgaggaagccattgctgagctggacactctgggtgaagaatcatacaaggacagtaccctcatcatgcaactattgagggacaacctcactctctggacttcagatgcgcaggaccagttagatgagtcatagaagggcatcataagctcgacctgtcctgtgc

SEQ ID NO: 288 - DNA, 982 bp, Cucumis sativus
gcaaaagcagcagaggcaaattcgaagccacgatttcagttccagttggagaagcgatggcgaaagagagagaactactcgtttactctgctaaattggctgaacaagctgagagatatgaagagatggttgaggaaatgaagaaaattgcgaagttaaatgtggaattgactgtggaagaaagaaatctgctatctgttggctataagaatgtaataggagctagacgagcttcctggcgtattttgtcttcaattgaacagaaggaaactaccaaacataatgagaagaacgtggaacggataattggttacaggcatggggttgaagatgagctctctaaaatatgcagtgatatattgtcaatcattgaccagcatctccttccatgttcctcagctggagaatctactgtgttctaccataagatgaaaggagactactgtcggtatttggctgagtttaaatccggtgatgagcataaacaagttgcggatcagtcattaaagtcttacgaggctgcttctgcaattgctaactctgatttgtctccaactcatcctataagacttggcttggctctgaacttctctgttttctactacgagatattgaattcccctgaaagggcctgccaccttgctaagcaggcctttgatgaggctattgcagaacttgacagtctcaatgaggaatcctacaaggacattacccttattatgcagctccttagggacaatctgactctgtggacatccgatcttgcagatgaaggagagcagtccaatgccgatgaactttaggtagagagttaaatcaacatgacacttggttactggggttgaagcattgaacgatggaacatgcagtagttaatagttgttattaactgttatttgggcatgttgataggacacaatagggttcactgaaattattagctctgttttctattctgtgtttcgaagatgttgttcttcca

SEQ ID NO: 289 - DNA, 693 bp, Cucumis sativus
gcgtagctttgtttaccaccaaacatacataacattcaaaccaaaggacgattttactcagctcagttctctcttcctcccgcactaagtctctctaatggcgtccctcatccctgaaaacctaacaagggagcagtatgtttacctatccaagctttccgagcaagccgagcgctacgaggaaatggttgacttcatgcaaaagcttgtattgacctccactcctgcctccgagctcactgtcgaggagcgcaatctcctttccgttgcatacaagaacgtgatcggttctctccgagcagcttggcgcatcgtatcctccattgaacagaaggaagaaggaaggaagaacgaagatcatgtcgtcctcgtcaaagattacagatccaaggtcgaatccgaactcaccgaggtctgcgcgaatattttgaagcttttggactccaatctcataccatcttcgtcctctggtgaatctgaggtgttctacttaaagatgaagggagattaccataggtatttggctgagtttaagattggggaggagaggaagtccgccgccgaggataccatgctagcttacaaggctgctcaggatattgcagttgccgatcttgcaccaacgcatccaatcaggctgggcctagcactaaatttctctgttttttactttgagattctgaaccagtctga

SEQ ID NO: 290 - DNA, 1293 bp, Cucurbita maxima
ggttagcttaatactttgcgagtactctattatctgttgttaccgtgctgaagctactacaaatgatttctagtgctgcatttgttgatcccgagggaaacgagtgtcagcgttcttgctggcacaccaccctgtgtcctcccttttggggttcaacgtcctctctgacatatcacctccttttcctcacaagcttcccctcgaagttttaaaaatgtgtctgctagagagaggtttccacactcttgtaaagaatgtttcgttctcttctccaaccaatgtggccacacccttataaataatgtttcgttctctctctctcccaccgtccatcttgaatccaacggctcacatttaatccatctcttctctctgctcttcgtcctcaacgcaattatcgaaccactctctctctctctctctctctctctctcgcagaaggaagacaaaaactcgaacaccaaatactccaactccttcggttccctctccctcgatttcgattccgccttcttgaactcataagatctaatcgttcctctttgtttctgcaatggcggtcgcctcttcccctcgcgaggagtatgtttaccttgctaagcttgccgagcaggccgagcgctacgaggagatggtcgagtttatggaaaaggtctccgccgccgtagacaacgaggagcttaccgtcgaggagcggaaccttctctctgttgcttacaagaatgttattggagcgcgtagagcttcctggaggattatttcctccattgagcagaaggaggagagccgagggaacgatgatcatgtctcgatcatccgagattacagatccaagatcgagactgagctgtctaacatctgcgatgggatccttaatcttcttgactcgcgccttattccctccgctgcgtccggagactccaaggtgttttatctcaaaatgaagggcgattatcatagatacctggctgaattcaagaccggagccaagcggaaggaatctgccgaaagtaccctcactgcttataaatctgctcaggatattgcaaatgctgaactttctcctactcaccccatacgacttgggctggctttgaatttctcagtgttctactatgagattctgaattcccctgatcgggcatgcagccttgctaaacaggctttcgacgaggcaattgctgagttggatacattgggcgaggaatcatacaaagatagcactttgatcatgcaacttcttcgtgacaacctcaccctatggacttcggacatgcaggatgatggagatga

SEQ ID NO: 291 - DNA, 780 bp, Cucurbita maxima
gggctctcctcctctctttcttcctcttcctctttcaccctctgatcccaaatccaccagtcctcagatccaatctccatttccttgcaatggctaccgccccctctcttcgcgaggagaatgtttacatggccaagcttgcggagcaggccgagcgctacgaggagatggtcgagttcatggagaaggtttccgcttctatcgacaaggaggagctcaccgtcgaggagagaaacctcctctccgtcgcctacaagaacgtcatcggcgctcgtagggcctcttggcgtattatttcctctatcgagcagaaggaggagagccgaggtaatgatcaccatgtctctgtgatccgtgactacagatccaaaatcgagagcgaactctctaatatctgcgatggaattctcaaactcctcgattccagacttattccctccgcggcctccggagattccaaggtattttaccttaaaatgaaaggcgattaccatagatacctggctgaattcaaaaccggtgccgaacggaaggaagctgccgaaagtaccctcactgcttacaaagccgctcaggatattgcaaatgccgagttgcctcccacgcatccgatccgacttggattggctctcaacttctctgtattctactatgaaattttaaattcccctgatcgtgcctgcagtcttgcaaaacaggcgtttgatgaagccatcgctgagttggataccctcggtgaggaatcctacaaggatagtactttgattatgcaacttctcc

SEQ ID NO: 292 - DNA, 1259 bp, Cucurbita maxima
  misc_feature (1)...(1259): n = A,T,C or G
ccggggcggcgaacggtngaaaacgcaaatctctctgtctccgtctctatctctctttctctctccatcgcttcaagctcgccggagtttaataatggccgcctccgtgccggacaatctctctcgcgagcaatatgtgtatctagctaagcttgccgagcaggctgaaagatatgaggagatggttcagttcatgcagaaacttgttcttggttcaaccccaggctccgagctctctgtcgaggagcgaaatcttctctctgttgcttacaagaacgtgattggctcacttcgagctgcttggcggattgtctcttccatcgagcagaaggaggagagccgtaagaatgaagagcatgttgttcttgttaaggattatagatcaaaggttgagtccgagctttccgaggtctgtgctagtattttgaagcttttggactcgaatctaattccatcggcatgtgctagtgagtctaaggtcttctacttgaagatgaagggggattaccataggtatatggcggagtttaaggctggggatgagaggaaagctgctgctgaggatgctatgctggcttatagggatgctctggatgtcgcagttgcggatcttgcacccactcatccgataaggctgggtctggcactcaatttctctgtgttttacttcgagattctgaatcagtccgataaagcatgtagcatggccaaggaggcatttgaggaagccatcgctgagctggacactttgggtgaagaatcatacaaggacagcaccctcatcatgcagctgttgagggacaacctcacgctctggacttcagatgcgcaggaccagttagacgagtcgtagaaggtggcatgagctcgacctgtcctgtgattgtgaatggtgggggaggaggaggtgggcttcaaatgtcattttcttatgctatttaaaatgtgtgaatctggaaattaaacacattggtctgtgcctgatgtccttgtactcagactagccttgatcttcaattccgaagttccaaaattggtgggtttttcttctttcttttcatcttttcatcttttctcttctccccgatccagatgggttcttttttaccttaaaaagaatcagattgaaacaacattttaggttcattctctttaatctcaaggttgataatcatatcaggtaattcgattgaacacagccgatggatttatggcatttgattttggtcaatatatattgagaataatgcaaaaaaaaa

SEQ ID NO: 293 - DNA, 828 bp, Cucurbita maxima
gctcaacgcaattatcgctcctctctctctctctctcgcgcgcgcgcggaggagaaaagaaaagaaagaacacagaaagaagggaaagaaaaattatcgaacccccaaattctccagctccttcggtttcttctccctctattttgaatcctgctctctcagattcttcagatctaagcgttcctcctcgtttctgtaatggcggtcgcctcttcccctcgtgagaagtatgtttacatggccaagctcgccgagcaggccgagcgctacgaggagatggttgagtttatggaaaaggtctcggccgccatagaaaacgaggagcttaccgtcgaggagcggaaccttctctctgttgcttacaagaatgttattggagctcgtagagcttcctggaggatcatttcttccatcgagcagaaggaggagagccgagggaacgatgatcatgtttccgtgatcagagaatacagatctaagatcgagagcgagctctctaacatctgtgatgggatcctcaagcttcttgactcccgccttatttcctccgctgcttctggagattccaaggtgttttatctcaaaatgaagggtgattatcatagatacctggctgaattcaagaccggggccgaacggaaggaggctgccgaaagtaccctcactgcttataaatctgctcaggatatcgcaaattctgaacttgctcctactcaccccatacgacttgggctggctttgaacttttcagtgttctattacgagattctgaattcccctgatcgagcttgcagccttgccaaacaggcttttgatgaagcaattgct

SEQ ID NO: 294 - DNA, 1095 bp, Cucurbita maxima
  misc_feature (1)...(1095): n = A,T,C or G
gttcccctcctccctctcttcctctctctattctcttcttcttcccattgtctctgcttctctctgttgtttttcgcattttttgttccgttcttttccgctctctcaaaccatgtcttccgccgagaaggagagagaaactcaggtctacatggccaagcttgctgagcaggccgagcgctatgacgaaatggttgagtatatgaagaatattgcaaagcttgacctcgaactaactgtagaggagaggaaccttctttctgtggggtacaaaaatgtgattggtgcacgacgagcctcttggcgcatcatgtcttcaattgagcagaaagaggagtctaaggggaatgagaacattgtaaaattgataaagagttaccgccagaaagtcgaggaggaactttcaaagatttgtggtgatattctctctatcatagacaagcatctaatccctcattcgtctgctgcagaagccactgtcttctactacaagatgaaaggtgattactatcgttatcttgctgagttcaagacagatcaagatagaaaagaggctgctgatcagtcgttgaagggatatgaggctgcctcaggcactgcgaataccgaactcccatcgacccacccaatccgtcttggtcttgctctcaacttttctgtcttctactatgagattatgaattctcctgagagagcttgccatttggctaaacaagcttttgatgaggcaattgcagagttggataccttgagtgaggaatcatacaaggacagcactctgatcatgcagctgttgagagacaatctcaccctctggacctccgatttgcctgaagatggcggtgacgaaaacttcaaagctgaggaatccaaacctgctgaacctgaggcccagcaaggcaaatgaaagattgatgggcaaactacacaaatgatgtgtgttgagatggaagaagaagtgtgttgttcctttttaaaagagaaattttaaaaaatagctctctctctctctctaaaacacagtgtggnggattggactgcacaataaaacaattcaattcattgcggcgttttttaaaaaaccaactaaaaaat

SEQ ID NO: 295 - DNA, 1168 bp, Cucurbita maxima
ggtggtttctttgtgggtctgactcggtctctctcttttcgagccagaaccaccgaaaaacccacactgtattgcaaaccctaattctttggtctcagatcggccatggcttccagtaaagaacgcgagaacttcgtttacgtcgctaagctcgccgagcaggccgagcgttatgatgaaatggtggaagcaatgaagaatgttgcaaagcttgaggttgaattgacagttgaggaaagaaacttactttctgttggatacaagaatgtggttggtgcacggagagcctcatggaggatcttatcatcaatagagcagaaagaagaagctaaaggaaatgaagcaaatgctaaacgcatcaaggaatacagacaaaaggttgaaacagagctctctggtatttgtgatgatatcatgacagtgattgacgagcacctaattccattggcttcagctggggaatcgacagtgttctactataagatgaaaggagattattatcgttaccttgcagaatttaaatctggtaatgagaagaaagaagcagctgatcaatcgatgaaggcatatgaggctgcaaccagctcagccgaatctgaattaccccctacacatcctatccgtttgggtttggcattaaatttctcagtcttctattatgaaatcctgaattcacccgaaagggcctgccaccttgcaaagcaagcttttgatgaagccatatccgaacttgacacccttaacgaggagtcatacaaagatagcaccttgatcatgcagcttcttagggacaaccttacattatggacttctgacatcccagaggatggagatgatgcccaaaagaccaatggaacagccaagatttctggtggtgacgatgccgagtgaagcggatagcatcataagtggcagaatcatgactctggagatgatggatgtgactcgataattgctcttggtgtttagcataaggagggttccttttattatcttccctttgttcttctccttttccccccctcccccttttctgatgcccattatggtgtggttttatttttgagtatgatgtctggacacttgtttggtctataatcttgcattcgcacaagctttcccttctcagtggatggtctcgataggttgtagggggatcgacttgaat

SEQ ID NO: 296 - DNA, 1200 bp, Cucurbita maxima
ggttggtttcgccagtttcgtggggtctgactctgcctctctctttctggagccagaaccaccaaaaaaacccacactgtacagaaaaccctaattctttggtctcagatcggttatggcttcatccagagagcgcgagaacttcgtttacatcgccaagctcgccgagcaggccgagcgttatgatgaaatggtagatgcaatgaagaatgttgcaaagcttgatgtcgaattgacagtggaggaaagaaatttactctctgttgggtacaagaatgtggttggtgcaaggagagcctcatggaggattttatcatcaatagagcagaaagaagaagctaaaggaaatgaaacaaatgccaagcgcatcaaggagtacagacaaaaggttgaaacagagctctctggtatttgtactgatatcatgacagtgattgacgaacacctaattccctctgcttcagctggggaatcaacagtgttctactataagatgaaaggagattattatcgttaccttgcagaatttaagtctggtaatgagaagaaagatgcagctgatcaatcgatgaaagcatatgaggctgcaactagctcagccgaatctgaattgcctcctacacatcctatccgcttgggtttggcattaaatttctctgtcttctattatgaaatcctgaattcacctgaaagggcttgccaccttgcaaagcaagcttttgatggagccatctccgaacttgacaccctcaatgaggagtcttacaaagatagcaccttaatcatgcagcttcttagagacaacctcacattatggacttctgacatcccagaggatggagatgatgcccaaaaggtcaacggcaccgtcaaagttgctggtggcgtcgatgagtgaagcggatagtattcaaagtggcagaatcagtactactctggggatgatggatgtgactcgataatcaattgcccttagtgtttagcataaggagggttcctttttattttcttttctttttctccttccctcttctctgatgccccattattgtgtggtttattttgagtatgatgatgtctggacttatttggtctagctttcccttctcagtggatggatggttgataggttgtaggaggaatgacttgaattgttaaagtgtttatccatcctgtttacatgaaaaatgcgtttgtcta

SEQ ID NO: 297 - DNA, 645 bp, Cucurbita maxima
gctcactctctggtctcggttttctctagtttgttacattgaagatgtcgactgttgattcttcacgggaggaaaatgtttacttggccaagttggccgaacaggctgaacggtatgaggaaatggtagagttcatggagaaagttgccaaaactgtggatgtggaggagctgactgttgaggagaggaatcttctctctgttgcttacaagaatgtcattggggctcggagggcctcttggaggataatatcttccattgagcagaaggaagaaagtcgcggaaatgaggaccatgttgcaattatcaaggagtaccgtggcaaaatcgaaactgaattgagcaagatctgtgatgggatcttgagcctacttgagtctcatctcatcccatcagcctcgtctgccgagtcaaaggtgttttatctcaaaatgaaaggtgactaccacaggtatctggctgagtttaagactggagctgaaaggaaagaagcagctgagagcacattattagcttacaagtctgctcaggatattgctcttgctgaattggctcctacacatccaattaggctcggtcttgctcttaacttctccgtgttttattatgagatccttaattcgccagaccgcgcttgcaatttgg

SEQ ID NO: 298 - DNA, 653 bp, Sicyos angulatus
tccgatcccaaaaccagaaaaccagacctcagatccaaatctccgttcccctgcaatggccgccgccgccgccccctctgtccgcgaggagaacgtctacatggccaagctcgccgagcaggccgagcgctacgaggagatggtcgacttcatggagaaggtctccgcttctctcgacaaggaggagctcaccgtcgaggagcgcaacctcctctccgtcgcctacaagaacgtcatcggcgcccgcagagcttcctggcgcatcatctcctccatcgagcagaaggaggagagccgaggtaacgacgatcatgtctccgtcatccgtggctacagatccaagatcgagaaggagctctctgacatctgcgatggaatccttaagcttcttgattctagactcattccttccgctgcgtctggagattctaaggtgttttacctcaagatgaagggcgattatcatcgatatctggctgagttcaaaaccagcgctgaaaggaaggaggccgctgaaagtaccctcactgcttacaaggctgctcaggatattgcaaatgctgagttgcctcctacacatccgatccgactcggattggcccttaacttctctgtattttactatgaaattttgaattctcctgatcgtgcct

SEQ ID NO: 299 - DNA, 1707 bp, Arabidopsis thaliana
atggagcattacgaggttcttgagcaaattgggaaaggttcttttgggtcagctcttcttgtgaggcataaacatgagaagaaactttatgttttgaagaaaattcggttagctaggcagactggtagaacaagaaggtctgctcatcaagagatggaattgatctcaaagataaggaatccatttattgtggaatataaagattcttgggttgagaaaggttgctatgtgtgcattgtcataggctattgcaaaggcggtgacatggccgaagcaataaagaaagccaacggcgtagagttctctgaagagaaactctgcaagtggctggtacaactcttaatggctcttgaatacttgcacgccagtcacattctccatcgcgatgtcaagtgttcaaacatattcttgacaaaggatcaagatatacgcctaggtgatttcggacttgcgaagatcttgacatctgatgaccttgcttcttcagtggttggaacgccgagctacatgtgccctgagcttcttgctgatattccctacgggtcaaagtcggacatttggtcgctgggttgttgtatgtatgagatgacggcgctgaaaccggcattcaaagcctttgacatgcaaggtctgatcaacaggataaaccggtccatcgttgctccacttcctgcgcaatattctaccgcctttcgcagtctcgttaaaagcatgctcaggaagaatccagaactcagaccaagcgcttctgatcttctcagacagccactacttcagccctacgttcaaaaggttcttctcaagctgagcttccgggaacacgatacattgccatctgaatccgaaaggagaagtagctatcctcagcagagaaagcgtacttctggcaaaagtgtgagcttcggtccaagcaggttcggtgttgaccaagaagattctgtttcttctgttaaacccgtgcacacgtatttacaccgtcacaggccagtggatttgtctgcaaatgacactagtagagtggttgttcgtagacccgctgtttcttcagtggtttctaacagttcaaaatatgtgccagtgagatcaaaccagcctaagagtggtggtctgctgaaacctgcggtagtgactcgtagggcctccttacctatctcacagaaacctgcaaaaggaacaaaagactctctataccacccgaacatcggtatactccatcagctaaattctccagatgtgtcagtaaactcgccaagaatcgacaggatcaagttcccgttagcttcatatgaagaaatgcctttcattcccgttgttcgcaagaagaaaggatcgtccagaggatcatacagcccgcctccagagccaccactagactgctcaataacaaaagacaaattcacacttgaaccagaacgagaaaccaaaagtgatttgtctgatcaaaatgcaactgctggagcatcaagtagagcttcctcaggtgcatcaagaagacaaagattcgaccctagctcatatcgacaacgagctgaggcacttgaaggactacttgaattcagtgcaagattacttatagacgagaggtacgatgagctgaacgtgttactaaaaccatttggtccgggaaaggtatcgccaagagaaaccgcgatatggttgtctaaaagcttcaaggaaagtagtcctagtaacttggaagaagattga

SEQ ID NO: 300 - DNA, 2826 bp, Arabidopsis thaliana
atggagtcacgaatggatcagtacgagcttatggaacagatcgggagaggagcgtttggtgctgctattttagttcatcataaagctgagagaaagaagtatgttttgaagaagatcagattagctagacaaacggaacgttgccggagatctgctcatcaagagatgtctttgattgcaagagttcaacatccttatattgtggagtttaaagaagcttgggttgagaaaggttgctatgtttgtattgtcactggatactgtgaaggaggagacatggctgagttgatgaaaaagtcaaatggtgtttattttcctgaggagaaactttgcaagtggtttactcaattattattagctgttgagtatctgcattctaactatgttctacatcgggatctaaagtgttccaacattttccttacaaaagatcaagatgttcgccttggggactttggtcttgccaaaactttgaaggcggatgacctaacttcctcggttgttggaactccaaactacatgtgcccggaactgcttgctgatatcccttatggttttaagtcagatatctggtccttaggctgttgtatatatgagatggctgcgtatcgacctgctttcaaagcttttgatatggcagggcttataagcaagaaaagcactcatcaagggaatgttaaggaagaaccccgagtatcggccaaacgtatggcctccgagattttgaagcatccttatctgcagccatatgttgagcagtaccgtccaacgctttctgcggcgtctataactccagaaaagcctctcaattctcgcgagggtcggaggagtatggctgaaagtcagaatagcaatagttcaagtgaaaaagataacttctacgtgagtgacaaaaatatccgatatgtggttccaagtaatggtaataaagtcactgagaccgattcaggttttgtcgatgatgaagacatcttagaccatgtgcaacaatcagctgaaaatggtaatctccagagtgtttcagcaacaaaaccagatggccatgggattttaaagcccgtacacagtgaccagcgaccagacgttattcaaccaaggcacccaaaaactatcagaaacatcatgatggttttgaaagaagagaaagctcgagaaaatggttcacccatgagatctaatcgaagtagaccttctagtgttccgacacagaagaataatgttgaaactccatcaaagattcccaaacttggtgacattgctcatagctccaagactaacgcaagtacgcctattccaccatcaaagctggcctctgattccgcaaggactccaggatcatttccaccaaagcatcatatgccagtgattgactcttctccaaaacttaagcctagaaacgacagaatttcaccttctcctgctgctaaacatgaggctgaagaggcgatgtcagttaagcgtaggcaaagaacacctcctactttgccaagaagaacgtctttgatagcgcaccagtcgagacaactaggagcagatatttcaaatatggcagcaaaggaaaccgcgaagctacatccatctgtgccatcagagtctgaaactaattctcatcaatctcgtgttcatgcttctcctgtgagtacgacgccagagccaaagagaacctctgttggatctgccaaaggaatgcagagtgaaagcagcaactctatctcgtcgtcgttgtccatgcaggcatttgagctctgtgatgatgcttccaccccatatattgacatgacagaacatacaactcctgatgaccacagaagatcctgtcacagtgaatactcatattcatttccagatatctcctcagagatgatgatccgtagagatgaacatagcaccagtatgcggctgactgaaattcccgactctgtttccggtgtacaaaacaccattgcccatcatcagccagaaagagagcaaggaagctgtcccactgtgctcaaagatgatagtcctgcaacattacagagctacgagcctaacacatcacaacatcaacacggtgatgacaaattcacagtcaaagaattcgtctcctctgttcccggacccgcaccattgcctttgcatgttgaaccatcacaccaagtgaattcccactcggataacaaaacaagcgtaatgtctcagaactcagctcttgagaagaacaacagtcattcccatcctcatcccgtggttgatgatgtcatacatgttattcgccacagcagtttccgagtagggagcgaccagccggtcatggaaagtgttgaagtcggtgtccaaaacgtcgatatggggaaactcataaacgttgtgagagatgaaatggaagtgagaaaaggagccactccctcagaatcacccaccacaagatcgatcatctcagagcctgactcaagaaccgagcctcgtcctaaagaaccagaccccatcaccaattactcagaaacaaagagctttaactcctgctcggattcttcaccagctgagaccagaactaactcattcgtgcctgaagaggaaacaactccgactccacctgttaaagagacgttggacatcaagtcgttcagacagagagcagaagcgcttgaaggtctattggaactatctgcggatttgctggaacagagcaggctcgaagagctagccattgtgttgcagccgtttgggaagaacaaagtttcgcctcgagaaaccgctatttggttggccaagagtttgaaaggaatgatgatcgaagacatcaataataataatagcagtggcagctccaggaattgttcatga

SEQ ID NO: 301 - DNA, 387 bp, Arabidopsis thaliana
atggatcttgaattactacaagatttgtccaaattcaatttcccaacacccatcaagatccgatccaaaacctcaaaaacaaagaaggacgaaggtgatgacgacgaagatgacctccgctgcagcacacccacatcccaagaacacaagattcccgccgtcgtagactctccacctcctccgccgagaaaaccccggccaccaccgtcagcaccgtcggctacggcggctctgatgatcagatcgtgcaagaggaagcttttagtgtcgacttgtgagataatcatgaatcgggaagagattgaccgtttcttctcctccgtctacaatgagacgtcgactacggctaaacggcggagaagttacccttattgttctcgaagatga

SEQ ID NO: 302 - DNA, 948 bp, Arabidopsis thaliana
atgggaacgagcgaagacaagatgccatttaagactaccaaaccaacatcttcggctcaggaagttcctcccacaccgtatccagattggcaaaattcaatgcaggcttattatggcggaggaggtactccaaatccttttttcccatccccagttggatctcctagtcctcacccctatatgtggggtgctcaacaccatatgatgccgccttatggcaccccagttccgtacccagcaatgtatcccccgggggcagtctatgctcatcctagcatgcccatgcctcctaattctggtcctaccaacaaggagcctgcgaaggaccaagcttctggcaagaagtcaaaggggaactcgaaaaaaaaggctgaaggaggtgataaagcgctctctggttcagggaacgatggtgcctctcatagtgatgaaagtgtcacagcgggttcatctgatgaaaatgatgagaatgccaatcaacaggaacagggttcaattcgaaagccaagctttggacagatgcttgctgacgcaagttctcaaagtacgactggtgaaatccaaggttcggtgcccatgaagccggtagccccggggactaatctgaatatcgggatggacttatggtcttcccaagctggtgtaccagtgaaggatgaacgagagctcaagcggcagaagaggaaacaatctaaccgtgaatccgctaggcggtctagattgcggaagcaggccgaatgcgaacaacttcaacaaagagtagagagtttgtcgaacgagaatcaaagcctgagagatgagctacagagactctcaagcgaatgtgataagctcaagtctgagaacaactcaatccaggatgagttgcagagagtacttggagcagaggctgtagctaatctagaacagaatgctgctgggtcgaaagatggtgaaggaacaaattaa

SEQ ID NO: 303 - DNA, 1224 bp, Arabidopsis thaliana
atggctagcaatgagatggaaaaatcgagtaaagagaaggaacctaaaacacctcctccttcttctactgcccctccctcttcacaggaaccttcatcggctgtgagtgctggcatggctactccagattggtctggttttcaggcatattctcctatgccgccgcctcatggttatgtggcatctagtccccaacctcacccttatatgtggggagttcagcatatgatgcctccttatggaactccgcctcatccttatgttgcaatgtatcccccaggtggcatgtacgcacatccttcaatgcctccgggttcttatccctatagcccttatgctatgccttctccaaatggaatgactgaagtttctggcaatactacaggcggcactgatggtgatgctaaacaatctgaagtgaaggaaaaattgcccatcaaaagatcaagaggaagcttgggaagtttgaacatgattacaggaaagaacaatgaacctgggaaaaactcaggagcatcagctaatggagcttactccaaaagtggggagagtgcttctgatggttcaagtgaaggaagtgatgggaactctcaaaatagttctttattgtttttccattcagctgaagcagcatcagagaatggtggttctgccaatggtccgcaaaatggaagtgctggtacacctattctaccggtgagccagaccgtaccaatcatgccaatgacagctgcaggtgttcctggcccaccaacaaatttaaatattgggatggattactggggtgctccaacttcagctggtatccctggaatgcatgggaaagtatctacaccagttcctggagttgttgctccaggctcgcgagatggtggccattcacaaccctggttacaggacgatagagaacttaagcgacagagacggaagcagtccaatagggagtctgctcgaagatcaaggttgcgtaaacaggccgaatgtgatgagctggcccaacgcgctgaggtgttgaacgaagaaaacacaaatctcagagcagaaatcaacaagctcaaaagccaatgcgaagagcttaccaccgagaacacctctctcaaggaccaactttcattattccctccacttgaaggcataagcatggacaatgaccaccaagaaccagacaccaatcaaacaggtgccgcagagagaaaggttgattcatacaaagactcaacgtga

SEQ ID NO: 304 - DNA, 522 bp, Arabidopsis thaliana
atgcagccgcaaacagacgttttcagcctccataactacctaaactcatcgatactgcagtctccgtatccttctaatttcccgatatctacgccatttccaaccaacggtcaaaacccgtacctcctctacggattccaaagccctacaaacaatccacaatccatgagcctaagcagcaacaactcaacatcagatgaagcagaagagcagcagacgaacaacaatataatcaacgagcggaagcagagaaggatgatttcaaaccgagaatccgcaaggagatcgcgtatgaggaagcaaagacaccttgacgagctttggtcacaagtgatgtggttaaggatcgagaatcatcagttgcttgataagcttaacaatctctctgagtctcacgacaaggttcttcaagagaatgctcagcttaaagaagaaacatttgagcttaagcaagtgatcagcgatatgcaaattcaaagccctttctcttgctttagagacgatataatccccattgaataa

SEQ ID NO: 305 - DNA, 834 bp, Arabidopsis thaliana
atggataatcacacagctaaagacattggtatgaagagaagtgcttctgagctggctctacaagagtatctcactacaagccctctagacccttgtttcgacctcatgaaccgggattacacttgtgagttaagagatagtcttttgtggtctgagggattgtttccggctggaccttttcgcgatgcacagtcctcaatctgcgagaatctgtcagctgatagtccagtgtcagccaataaacctgaggtaagaggaggagttaggagaaccacaagtggatcttctcatgttaactctgatgacgaagatgccgagacagaagcagggcaatctgaaatgactaatgatcccaatgatctgaaacgtattagaaggatgaactcaaacagggaatcagcaaagaggtcgaggagaaggaagcaagagtacttggtagatcttgagactcaggttgattctttgaaaggcgataactcaacactgtacaagcagctcatagacgcaacacaacagtttcgtagcgctggaacaaataacagagttctcaaatcagatgttgaaactctgagagtcaaggtgaaactagcagaagatttggtagcgagagggtcactcactagcagcttgaatcaacttctacaaactcatctaagtccaccatcacactccatcagcagtctgcactacacgggaaatacctcgcccgccattacagtccacagtgaccaatctttgttccctggaatgacactttctggacagaactcaagccctggacttggtaatgtatccagtgaagctgttagctgcgtctcagacatctggccatga

SEQ ID NO: 306 - DNA, 1254 bp, Arabidopsis thaliana
atgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgattgttgattccgatgattatcgtcgtgttcttaagaacaagcttgagactgagtgcgctactgttgtttctcttcgggttgggtctgtgaagcctgaagattcgactagttctccagaaactcaacttcaaccagttcaatccagtcctcttactcaaggttctttgatgaccccaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactga

SEQ ID NO: 307 - DNA, 441 bp, Arabidopsis thaliana
atggggtcgttgcaaatgcaaacaagtcctgaatccgataatgatccgaggtacgccacggtgacggatgagaggaagaggaagagaatgatctctaacagagaatctgctcggaggtcaaggatgaggaaacagaagcaacttggtgatttgatcaacgaagtcactcttctcaagaatgataacgctaaaatcactgagcaggttgatgaagcttcaaagaaatacattgaaatggagtctaagaacaatgtcttgagggcacaggcttcggagttgacggataggttgagatcattgaactctgtgcttgagatggttgaagaaattagtggtcaggctttggatattcctgagattcctgaatctatgcagaacccttggcagatgccttgtccaatgcaaccaatcagagcttctgctgatatgtttgattgctga

SEQ ID NO: 308 - DNA, 948 bp, Arabidopsis thaliana; identical to SEQ ID NO: 67

SEQ ID NO: 309 - DNA, 1365 bp, Arabidopsis thaliana; identical to SEQ ID NO: 58

SEQ ID NO: 310 - DNA, 780 bp, Arabidopsis thaliana
atggcgtctgggcgtgaagagttcgtatacatggctaagctcgcggagcaagcggagaggtacgaagagatggtagagtttatggagaaagtctccgccgccgttgatggcgatgaactcaccgtagaagagcgaaatcttctctccgtcgcttataagaatgtgattggtgctcgccgtgcctcgtggcgtatcatttcatcgatcgagcagaaggaagagagccgtggtaacgatgaccacgtcacggcgatccgtgaatataggtctaagatcgagacggaactctccggaatctgcgacggaatccttaagttgcttgactctagactcatccctgccgctgcttctggtgattccaaggtcttttaccttaagatgaagggagattatcacaggtacttggctgagtttaagactggtcaagagaggaaagacgccgccgaacatacactcgccgcttacaaatctgctcaggatattgctaatgcagagcttgctccaacacacccaattcgtcttggtcttgcattgaacttctctgtgttctattacgagatcctcaattctcctgatcgtgcctgtaacctcgccaaacaggcctttgatgaggcgattgcagagttggacactcttggtgaagagtcatacaaagacagtaccttgatcatgcagcttcttcgtgacaatctcactctctggacatctgatatgcaggatgatgctgcggatgagatcaaggaagcagcagcgccaaaaccgaccgaggaacagcagtga

SEQ ID NO: 311 - DNA, 804 bp, Arabidopsis thaliana
atggcgacaccaggagcttcctcagcaagagatgaattcgtatacatggcgaaactcgccgaacaagcagagcgttacgaagaaatggttgaattcatggagaaagtcgcgaaagctgttgacaaagacgaactcaccgtcgaagaacgtaatctcctctccgtcgcttacaaaaacgtcatcggagctcgtcgtgcttcgtggagaatcatttcatcgatcgaacaaaaggaggagtctcgcggtaacgatgaccacgtttcgttgatccgtgactacagaagcaaaatcgaaacggaactttctgatatctgtgacggaatccttaagcttctcgatacgattctcgttcccgctgctgcttctggagattcgaaggtgttttatctgaagatgaaaggtgattatcataggtacttggctgagttcaaatctggtcaagagaggaaagatgctgctgaacatactcttactgcttacaaagctgctcaggatattgctaattctgaattggctccaacgcatccgattcgtcttggtcttgcgttgaacttctctgtgttttactatgagattctcaattctccagatcgtgcttgtaatctcgctaagcaggcgtttgatgaagcaattgctgaattggatactcttggtgaagagtcatacaaggacagtactttgattatgcagcttcttcgtgataacctcactctctggacttctgatatgcaggacgatgttgctgatgacatcaaagaagcagcaccagcagcagcaaaacccgctgacgagcaacaatcctaa

SEQ ID NO: 312 - DNA, 804 bp, Arabidopsis thaliana
atggcggcaccaccagcatcatcctcggcgagggaagagttcgtgtacctcgcaaagctcgcagagcaagcggaacgttacgaagaaatggttgaattcatggaaaaagtcgctgaagccgttgacaaagacgaactcaccgtcgaagaacgtaatctcctctccgtcgcttacaaaaacgtaatcggcgctcgtcgtgcttcctggagaatcatctcttccattgaacaaaaagaagagagtcgtggtaacgatgaccatgtgaccacgatccgtgattacagaagcaagatcgaatctgagttatcgaaaatctgtgacggtattcttaagcttcttgatactagacttgttcctgcttctgctaatggagattctaaggttttttaccttaagatgaagggagattatcataggtatttggctgagtttaagactggtcaagagaggaaagatgctgctgaacatactctcaccgcttacaaagctgctcaggatattgctaatgctgaattggctccaacgcatccgattcgtcttggtttggctttgaatttctctgtgttttactatgagattcttaattctccagatcgtgcttgtaatctcgctaagcaggcgtttgatgaagccattgctgagttagatactcttggagaggagtcatacaaggatagtaccttgatcatgcagcttcttcgtgacaatcttactctctggacttctgacatgcaggacgaaagtccggaggagattaaagaagcagcagcaccaaagcctgctgaagaacagaaggagatctaa

SEQ ID NO: 313 - DNA, 747 bp, Arabidopsis thaliana
atggcgacgaccttaagcagagatcaatatgtctacatggcgaagctcgccgagcaagccgagcgttacgaagagatggttcaattcatggaacagctcgtaagtggagctacaccggccggtgagctgaccgtagaagagaggaatcttctctcggtcgcgtataagaacgtgattggatctcttcgtgcggcatggagaatcgtgtcttcgattgagcaaaaggaagagagcaggaagaacgaagaacacgtgtcgcttgttaaggattacagatctaaagttgagactgagctttcttcgatctgttctgggattctcaggttacttgattcgcatctaattccttcagctactgccagtgagtctaaggttttttacctgaagatgaaaggagattatcatcgttatttggctgagtttaaatctggtgatgagaggaaaactgctgctgaagatactatgatcgcttacaaagctgctcaggacgttgcagttgctgatctagcacctacacatccgatcaggcttggtttggctcttaacttctcagtgttttactacgagattctcaactcttcagagaaagcttgtagcatggcgaaacaggcttttgaagaagccattgctgagctggacacattgggagaggagtcatacaaggacagtactctcatcatgcagttgctaagggacaatctaaccctttggacctccgatatgcaggagcagatggatgaggcctga

SEQ ID NO: 314 - DNA, 792 bp, Arabidopsis thaliana
atgggttctggaaaagagcgtgacactttcgtctacctcgctaagctctctgagcaagctgagcgttatgaagaaatggtggaatcaatgaaaagtgttgcgaaattgaatgttgatctgacggtggaagagaggaacttactctctgtgggttacaagaacgtgattggttcaaggagagcttcgtggaggatcttctcgtcgattgaacaaaaggaagcagtgaaagggaatgatgttaatgtaaagaggatcaaagagtatatggagaaggttgagttagagctttctaacatatgcattgatattatgtctgtcttagatgagcatctcattccttcggcttccgagggtgaatctactgtcttcttcaacaagatgaaaggtgactattaccgctatcttgctgagttcaaatcagggaacgagaggaaagaggctgctgatcagtctttgaaagcctatgagattgctactactgctgctgaggctaagctccctccaacacaccctatcagattgggtttggctttgaatttctctgtcttctactacgagatcatgaacgcacctgaaagggcatgtcaccttgctaagcaggcgttcgatgaagctatctcagagcttgacactctgaacgaggaatcctacaaagatagcaccttaataatgcaactccttagggacaatctgaccttgtggacttctgacatctcagaagaaggaggagacgatgctcataagacgaatggttctgccaaacctggtgctggtggagacgatgcagagtga

SEQ ID NO: 315 - DNA, 798 bp, Arabidopsis thaliana
atgtcgtcttctcgggaagagaatgtgtacttagccaagttagctgagcaagctgaacgttatgaggaaatggttgagttcatggagaaagttgcaaagactgttgacaccgatgagcttactgtcgaagagagaaacctcttgtctgttgcttacaagaacgtcattggtgctaggagagcttcctggaggatcatatcttccattgaacagaaggaagaaagcagaggaaacgatgatcatgtttccattatcaaggactacagaggaaagatcgaaactgaactcagcaaaatctgtgatggaatactcaatcttctggattctcaccttgttcccactgcatctttggccgagtccaaagtcttttacctcaaaatgaaaggagattaccacaggtaccttgctgagtttaagactggagctgagaggaaagaagctgctgagagcactctggttgcttacaagtcagctcaggatattgcacttgctgatttagctcctactcatccgattagactgggacttgctcttaacttctctgtcttctactacgagattctcaactcacctgatcgtgcctgcagtctcgcaaaacaggcttttgatgaggccatttctgagctggatacattaggagaagaatcatacaaagacagtacgttgataatgcaacttctccgtgacaatctgaccctttggaactctgacatcaatgatgaggcgggcggtgatgagatcaaggaggcgtcaaaacatgagccggaagaggggaaaccagctgagacagggcagtga

SEQ ID NO: 316 - DNA, 807 bp, Arabidopsis thaliana
atgtcatcatcaggatccgacaaagagagagagacttttgtctatatggctaagctctccgaacaagccgagcgatacgacgagatggtggagacgatgaagaaagtggcgagggttaatagcgagctgactgtggaagagaggaatctgttgtcggttggttacaagaacgtgatcggagcaagaagagcttcgtggaggataatgtcgtccatcgagcagaaagaagagtctaaaggcaatgaatcaaacgtgaaacaaatcaagggttatcgccaaaaggtagaagatgagctcgctaacatttgccaagacattctcaccatcattgatcagcatctcatccctcacgctacctcaggggaagctaccgtcttctactacaagatgaaaggagattattaccgttacttggctgagtttaagaccgagcaagagaggaaggaagctgctgaacagtctctcaaaggctatgaggctgcaacacaagctgcaagcactgagcttccttcgacccatccaattcgtcttggccttgctcttaacttctctgttttctactatgagatcatgaactctcctgaaagagcttgccatttggctaagcaagccttcgatgaggcgattgcagagttagatactctaagtgaggagtcgtacaaggacagcactttgatcatgcagctcctgagagacaacctcaccctctggacttctgatcttcctgaagatggaggagaagacaacatcaagactgaagaatccaagcaagaacaggccaagcctgccgatgccactgagaactga

SEQ ID NO: 317 - DNA, 2390 bp, Arabidopsis thaliana
gtttgtcttccccttcattcgcaattgcttgcttggtgtgctgagaggggaggaggacgaggaggaggaaacagagcaacaagcagcccgacagacacacatctcaacaggtggatctttctcgcccgccattctatcaggtgtattattgtgcaacatatagctgaaatatggtttgggggatcttgtagtaggagcatacgatcaattttaggaaccaaggctcattttaactatgggtacaggagagatggggacaccagcgaaaacaactaaggcatccacaccacaggaacagcctccaacaagcactgccatgctttatcctgactgggctgcagcattccaggcttattataactctggaaccacaccaccacctcctcctgcgtactttcattcaagcgttgcatctagtccacagcctcatccatatatgtggggggggcagcctctaatgcctccatatggaactcttcctcccccatatgcggcaatgtatcatcatggcagcatgtatgctcatccatccatgcctccgggtgcacatccatttgctccttatgtgatgacatcgtcgttaagtacaactgaaggtgcacctgtaggcacaacttctggtgcagatgcagaaggaaagccatctgaaccaaaggaccaaactctattgaagaggtccaaaggaagcttaggcagtcttaatatgcttactggcaagattaatgaggctgacaaaggaacaggaggtggtgggaatggtgctttatctataagtggtgagagtgggagtgaaggttcaagtgaaaggagcgatgagacttctcaaaatggatcagaagccacacaaaagaagggatttgagctgaattctacaaaagctgctgaggcacaaaatacaactacaacttcatacaatgcccatggtgggagtgcatttggtgcatctggagtgcaaacagtaaatgcgactgtaaatttagccatagcagctgtcccaatctctgtagcaggcaaatctgccacagttgcagggtcaaagaccaacttaaatatgggcatggattactggagtggatcaaccactgcgacttcgaccatgcgtggaaagcgtcctgcagtgcccagaaccacagcaatggttcctgctcctcagagcatctctcttatggttccttgtgatggtgttcctacagaactttgggatgagagagaacttaaaagacaaagacgaaaacagtcaaacagggaatctgcaagacggtcaaggttgcgtaaacaggctgagtgtgaggacctagctaagcgagtcgacattctcaaagcagagaatgcttccttgaggaaagagctgaaccgattgggagaggaatgcaaaaagctctctactgagaatgcttttctccataaaaaactgtgcaaggctccagaggaagaaactagggacactagatcagaaaaggatggggaggctggaactggcgagcagcatgagcagcagaatgaggacacagacagcggagcagtggaatctatgcaaagggatggtagaagagaagaaacatcctttaatttagacggaaaaaaccaacctcttgataacaggaaccaagcagtgtctgtttctgctggttagcttgacgtaatctatccttctcatttctacggatgcctgatgccgctagtcattttctgttagacacggcttcaaatgccttggactggttgtcagtacagactaatcatgtatatgtatgtaagtgtggagacttttacccaattaatttaacattcgcagattgattgtataggaaaatatttacaggaagggaggacagcgaattacatggttcccttagtttcaatcaatatgatcaaagaggctaacaggagatagatttgaagtatataatccacaagcaagggattttaatttagattttcgtttggttgatgaacgtaatttgggtcagcggtcaactttgagctgttgttgctttgctgaattacctatactgcctgtatgaatattggcatgtgcttcaatcgcaaactttttgatgagtaagccagagaaattcacatggccactcactacacttactgacaacgaacaaactgtcaatagttattgacttagtttatagtcaagtggtggaaactgctttttaactttaggtgattggagtcatgaaattgtgaatgtaattgtatagactgacaattttcaccattggcagcctcttgtaataagcaaattgatactaaagttgctcttatttacaaacaattgagatcttttgggatgcttccctgaaagctcaagctggacattatacttctttgttgaccatattcaggaaaattatatcttacttttattaaaaaaaaaa

SEQ ID NO: 318 - DNA, 1120 bp, Arabidopsis thaliana
cctctcgtctccctctggtttccgttgtttctctctctctctctctctctctccctccctgccggaacgaacgatgtcgtcggagaaggagcgcgatgctcacgtctacctggccaagctcgccgaacaggccgagcgttacgacgaaatggtagagtgcatgaagaaggttgctaagcttgatctagatctgaccgtggaggagaggaatctcctctctgttggctacaagaatgtgattggggctaggcgagcctcgtggcgcatcatgtcctcgattgagcagaaggaagagtccaaaggcaatgagcacaatgtcaagctggtccgggactaccgacagaaggtagaggaggagctctccaagatttgcagtgacattctgtccatcatagacaagcacctgattccttcctccaatgccggagaagccaccgttttctattacaaaatgaaaggggactattaccgctaccttgctgagttcaagattgaccaggaaaggaaagaggctgcagagcaatctctgaaaggctatgaggctgcttcaagcactgcaaacacagaactcccgtccacccacccaatccgtctaggccttgcgctcaacttctctgtattctactatgagataatgaattctccagaaagggcctgccatttagccaagcaagcttttgatgaagcaattgcagagttggacacgttgagcgaggagtcctacaaggacagcaccctaattatgcaactgttgagagataacctgactctctggacctctgatttgcctgaagatggaggtgaagatggcatcaaagttgaagaacctaaacctgccgaacccgagcactgaccaatgtctcagtgatcaagaaaccgggcattaaatgactaggctgcaccatggatgcagtctttcttcttctccagcagactaagcagacaatgcggaaacccgcaagcagttattccgggcccaaagcaagtggagtagattgcttcacctccgtttcggttgcatctcttgacattttctttttgctgttcatgtttttactcgacgcttgtcatgtaaacgcagactccggatttcaatactctggttatcttaaaaaaaaaa

SEQ ID NO: 319 - DNA, 1180 bp, Arabidopsis thaliana
cttcctcctcccccttcctcaccagccagtcgtcgtctgcttgagggctagagagagagagagagagagtagagagagagtgtagagagagagagagagagaaggagatggcgtcgacgaaggagagagacggctacgtctacgtcgccaagctcgccgagcaggccgagcgctacgacgaaatggtggaggccatgaagaatgtggcgaagctcgatgtggagctgacggtggaagagaggaacctgctctccgtcggttacaagaacgtgatcggcgcgcggcgggcgtcgtggaggatcctctcttccatcgagcagaaggaggactcgaaagggaacgagcataatgtgaagaagatcaaggagtacaggcagaaggtcgaggccgagctggcgaatatctgcggggatgtgatgaaggtgatcgatgagcatttgattccttcgtgtgctggcggagaatcgaccgtgtttttctataaaatgaaaggagattactatcggtacttggcagagtttaaggctggtgatgacagaaaggaggcagctgatcagtctatgaaagcatatgagctggcttccaccaccgcagaggctgacctatccccgacacatccaatcagattgggtttggcattgaacttttctgtcttctactatgagatcatgaactctcctgaaagggcctgtcaccttgcaaagcaggcttttgacgaagcgatctcagagttggatactttgagtgaggaatcctacaaagacagcacattaattatgcagcttctaagggacaatctgacattatggacttctgacatccctgaggatggagctgaagatgctcagaagcttgataatgctgccaaagctgcaggaggtgaagatgcagagtgaggcagagtgttgcttgggagctcataaagggagtcaaatggtttgagggtggtgtttccttgtctgaaggcatattgagagacttttactttctgtttccttcacttttttcgtttcgtcgtcctcttttgcttcgacattgctactagctaattatttggtgcttgttctgtgctcccattctcacgactgctgattaaacctgataaaaattatgtcaagacagtctgttgtacgatctaagtctgtttaattgagaatgtagcgttattagaaaaaaaaaa

SEQ ID NO: 320 - DNA, 1668 bp, Arabidopsis thaliana
atggagcggtatgaagtcttggagcagatcgggaaagggtcctttggctctgctcttcttgttagacacaaacaagaacgcaagaaatacgttttgaaaaagattcgtctcgcccgccagtctgatagggctcgacgatcagctcatcaggagatggagctcatttctactgtccgcaatccatttgttgtcgagtacaaagattcatgggttgaaaagggttgctatgtgtgcattgttattggatattgccaaggcggggacatgacagataccatcaaaagagcatgtggtgttcattttcctgaggagaaattatgccaatggcttgtccaactattaatggccctcgattatcttcactccaaccatattcttcaccgcgatgtcaagtgttctaacatattcttgacaaaagagcaagacatacggcttggtgactttggactcgctaagattctaacttctgatgaccttacatcctctgttgttggaactccaagctacatgtgtcctgagcttcttgctgacataccttacggatcaaagtcagacatttggtcgttgggatgctgcatgtatgaaatggctgctcataaacctcctttcaaagcttccgatgtgcagacactgatcaccaaaatacacaagttgataatggatcctattcccgccatgtattccggctcattccgaggccttattaaaagcatgttgaggaaaaatcctgaactcaggccaagcgctaacgagctgcttaaccatcctcatcttcagccttacatcagtatggtttatatgaagctagagagccccagaagaagcacttttccactccaattttctgagagggacgctacattgaaggaaagaaggcgttcatcattcagcaacgacaggagattgaatccgagtgtctctgatacagaagcaggttctgtttcttcttcaggaaaagcatctcctacaccaatgtttaatggaagaaaagtgtcagaagtaactgtgggagtcgtcagagaagaaattgttcctcaacggcaagaggaagccaagaagcaatcaggtgcagccagaacaccaagagtggctgggacctcagctaaagcaagcacgcagcgtactgtttttaaacatgaactaatgaaggtatcgaatcctacagagaggagaaggagagtatctctgccgttggtcgtggaaaatccttacacttatgaatcagatattacagctctttgttccctaaattcaccggatgtttctgtaaacactccaagattcgacaagatcgctgaattccctgaagatatcttccaaaaccaaaacagagagacagcgtcaagaagagaagtagctaggcactctttttcttctcctccttgtccgcctcatggtgaggacaattccaacggttcgatcacaaaggacaagtgtactgtacagaaaaggtcagtttcggaggtaaaacagagaaggttcgacacgtcatcgtatcagcagcgtgcggaggctctggagggactgctggagttcagtgcaaagcttttgcagcaggaacggtacgatgagctcggggttctgcttaaaccctttggagccgagagggtgtcttcgagggagacggccatctggttgaccaagagcttcaaagaagcttccgtgtag

SEQ ID NO: 321 - DNA, 1284 bp, Arabidopsis thaliana
atggcaaacaagataagtgaaactgcttccaagatggacgattatgaggtcgtggaacagatcggacgaggcgcttttggttctgcttttcttgtaattcacaagtccgagagacgaaagtatgtggttaagaagattcgtttggctaaacaaacagagagatgcaagcttgctgcaatccaagagatgagtttgatatcaaagcttaagagtccttatattgtggagtacaaagattcttgggttgaaaaggattgtgtatgcattgtaactagttattgtgagggtggagacatgactcaaatgataaagaaatcaagaggagtattcgcgtccgaagaaaaactctgtagatggatggtgcagctactgttggctatagattacctccataacaatcgagttcttcaccgtgaccttaagtgctccaacatattcctcactaaagagaacgaggttcggttaggtgactttggcctagcaaaacttctaggcaaagatgatcttgcttcctcgatggtaggaacaccaaactacatgtgccctgaacttcttgcagatataccttatggctacaaatctgatatttggtctttaggttgttgtatgtttgaagtagctgctcatcaaccggccttcaaggctcctgacatggcagcactcatcaacaagattaaccgctcttcgctttctcctctcccagtcatgtattcctcttcattaaaaagactgatcaaaagtatgttgcgcaagaaccctgaacatagaccaactgctgcagaattgctaagacatccacacttacagccatatcttgcacaatgccaaaatctgtccccagttttcaaaccggttgtgtccaaatcagaacacaacaccaacgaaaacagaacaggtctccccccgaagaccaaatccgcaaaaacacccatcaaacacaatcaagaatcagaggaaacagagaagaaaaataaggatacgagctctagttcaaaagacaaggagagaccagcaaagagccaagagatgtcagtgattagcacattaacgttgctacgcgagtttcagaagaaaagcccgaaaagcgaggagagagcagaagcattggaatctttgttggagctttgtgcaggtttacttaggcaagagaagtttgatgagcttgaaggagtcttgaaaccttttggagatgaaacagtttcatcaagagaaaccgctatttggcttacgaagagtctcatgaatgtaaagagaaagcaaaacgatgatgaaaccaatatttaa

SEQ ID NO: 322 - DNA, 1988 bp, Arabidopsis thaliana
atggagaattacgaggttcttgagcaaattggaaaaggttcctttgggtcagctcttcttgtgagacataaacatgagaagaaactgtatgttttgaagaaaatccggcttgctcggcagactggtaggacaagaagatctgctcatcaagagatggagttgatttcaaagatacataatccattcattgtggaatataaagattcttgggttgaaaagggatgctatgtgtgcattatcataggctattgcaaaggaggagacatggcggaagcaataaagaaaaccaacggcgtacacttcactgaagagaaactctgcaaatggcttgttcagatcttattggctcttgaatacttgcatgccaatcacattctccatcgagatgtcaagtgttcgaacatatttttgacaaaggatcaagatatacgccttggcgattttggactcgctaaagtcttaacatcagatgacctcgcgtcttcagtggttggaacaccaagctacatgtgtcccgagctactagctgatataccctatgggtccaagtctgatatttggtcgctaggatgttgtatgtatgagatgacggctatgaaacctgctttcaaagcttttgacatgcaaggactaatcaacaggattaacagatcaatcgttcctccacttccggcgcaatattctgctgccttccgaggtctcgttaagagtatgctccggaaaaatccagaactcagaccaagtgctgctgagcttcttagacaaccgctgcttcaaccgtatatccagaagattcatttgaaagtgaatgatccaggaagtaatgtgttacctgcgcaatggccagaatctgaatccgccaggagaaacagttttccagaacagagaaggcgtcctgctggcaaaagccatagctttggtccaagcaggtttaggggtaacctagaagattctgtttcttccataaaaaaaactgtgcccgcatatctgaatcgtgaaaggcaagtggacttgtctacagatgcaagcggtgatggaacggttgttcgtagaacttcagaggcttctaagagttctaggtatgtaccagtgagagcttcggcctcacctgtgagacctagacagcctaggagtgaccttggtcaacttcctgtttcatcacaacttaaaaaccgaaaaccagctgctttgatacgtagagcctccatgcctagctcaagaaaacctgcaaaagaaatcaaagactctctgtacatttcgaaaaccagttttctccaccagataaattctcctgatgtgtcaatgaacgcaccaagaattgacaagattgagtttccgttagcgtcatacgaggaagagccttttgtcccggttgtgcgtgggaagaaaaagaaagcatcgtctagaggttcctacagtccacctccagagccaccactagactgctcaatcacaaaagacaaatttactcttgaaccaggccaaaacagagaaggagcgattatgaaggcggtgtatgaagaagatgcatatctggaagacaggagtgaatcatctgatcaaaatgcgacagctggagcatcaagcagggcttcgtcgggtgtaaggagacaaagatttgatcctagctcttatcagcaacgagccgaggcattggagggattgcttgaattcagtgcaaggttgcttcaagatgagaggtacgatgagctcaatgtcttattaagaccatttggtccaggcaaagtttcacccagagaaacagcgatttggttgtccaagagcttcaaggaaaccactactactaagctgggagattgagagacggatttctaattctaacctgttgtgacttgaaaattttccacctttaacagtttatcaagaaaattgtatcaaagtttaactacctaggttgtcttctttaatgagtagcggaccctctttgtctgatacattgaaattctagaaaaaacttggccggttac

SEQ ID NO: 323 - DNA, 595 bp, Pinus radiata
gcacagacatgtctcgcttcgtggagccactggtggtggggagagtgatcggagatgttctgcatatgttcgtgccaggcgtcgatctggctgttacctacgcgtccaggcaggtcaacaatggctgcgagcttaagccctcggcagttgcattgcttcctcgcgtcgacatcgggggtgaggacctccgcaacttttacactctggttatgacggatccagatgctcccagtcccagtgatccaacactgcgagaatacttacactggattgtaactgatattcctgcaacaacttcagcctctttcggcagagagctagtgagttacgagtcaccaagacctaccatcggtatccacaggttcatttttgtgttgttcaagcagatagggcggcagacagtttaccctccaagttctcgcatcaatttcaataccagaaatttcgcacgctccaacagccttggtctgccagtggcggctgtttatttcaatgctcagaaggagacagcaggtagaagacgctgaaggttaccttatgttaaaagtattttagagtatatgtttttattaagatcgttggatatctcactatc

SEQ ID NO: 324 - protein, 160 aa, Cucumis sativus
MEQYEILEQIGKGSFGSALLVRHKHEKKKYVLKKIRLARQTDRSRRSAHQEMELISKLRNPFIVEYKDSWVEKGCYVCIIIGYCEGGDMAEAIKKANSIHFPEEKLCKWLVQLLMALDYLHMNHILHRDVKCSNIFLTKDRDIRLGDFGLAKMLTSDDLA

SEQ ID NO: 325 - protein, 141 aa, Cucurbita maxima
MESRMDHYEIMEQIGRGAFGAAILVYHKSEKKKYVLKKIRLARQTERCRRSAHQEMALIARVQHPYIVEFKEAWVEKGCYVCIVTGYCEGGDMAELMKKSNGLHFPEEKLCKWFTQLLLAVEYLHSNFVLHRDLKCSNIFL

SEQ ID NO: 326 - protein, 106 aa, Cucumis sativus
MMPEQWVQDERELKRQKRKQSNRESARRSRLRKQAECEELQARVQTLNNENRTLRDELQRLSEECEKLTSENSSIKEELTRFCGPEALANFEKGNAAPPAQSRGGE

SEQ ID NO: 327 - protein, 227 aa, Cucumis sativus
  VARIANT (1)...(227): Xaa = Any Amino Acid
EWSGFQAYSPIPPPGYLATSPQAHPYMWGVQPIMPPYGTPPHPYVAMYPHGGIYAHPPMPAGSYPYSPFAIASPNGIAEASGNTPSNMEGEGKPSELKEKLPIKRSKGSLGSLSMITGKNNELGKPSGTSANGVYSKSAESESEGTSERSDADSENDSQLKSGSGKDSLEGGGTPNGLMHGSQNEGHSLAHPLVNQTMSIIPIQASGAVTGPATNXNIGMDYWGTPT

SEQ ID NO: 328 - protein, 235 aa, Cucumis sativus
EDNNGSLALGMFMGNQITENKNMVSNQNQNPVFLGTGVVRSSQPQQQQQPLFPKPANVTFASSMNLVNNPQLTNGSGTNLVVAPKPPLHDALIQGTGIGAIGLGTRGVTVASRSPTSTISSDVITKSSIEASSFSPVPFSFGRGRRSSGALEKVVERRQRRMIKNRESAARSRARKQAYTLELEAEVAKLKEMNQELQKKQREIMETQKNQVLEKMKYQLGGKRFCLRRTLTGPW

SEQ ID NO: 329 - protein, 124 aa, Cucurbita maxima
MSMDLEFPENLPKIRLPLQVRSPPKPSNSINIPSSVSDHDSADLDHRGCRTPTSAEHKIPKIISCPGAPRKPKRPPVPCKRKLTMELKFFEFVNQEEVDNFFRSAYDLEASSAAPPKRSCCRSA

SEQ ID NO: 330 - protein, 178 aa, Cucurbita maxima
QPGEVTSLQYLIPSNLSPYATHFPMAQNNLSTMQLNELSNPLYNFQGSSQFQDFNRHPCLSSNSTSDEADEQQQSLIDERKQRRMVSNRESARRSRMRKQKHLDELWSQVVWLRNENHQLIDKLNQVSDCHDKVVQENAQLKEQTSELRQMITELQVNNPYPKFRELEEIPPNTPSES

SEQ ID NO: 331 - protein, 207 aa, Cucurbita maxima
MKRSASELALEEFLKKAAVISPQVTDADADADDDVFNLEREEEVIRSPKRGKNFPDSACFFGDIDFSYFLVKNNREIMDAIVNRGAGLTEATIDSQSSIVSSPTSGSNLMGRERGRGNNSGSSEDQSDDEIEAGSYEQSTDPLASKKIRRMISNRESARRSRRRKQAQLSELESQVKQLKGENETLFNQLLDASQHYHDANTNNRVL

SEQ ID NO: 332 - protein, 210 aa, Cucurbita maxima
AEPKGPVQPAEHRGQTSSGFQFGLQAPGQVALGSDRGTSTKESDANGSPLGIPSLPAMPKKQGLQTAQTTSGSSRDESDDDDLEGDIENSENMHPSDARRARRMLSNRESARRSRRRKQAHLNDLETQVGQLRVDHSTLLKCLTDVNQKYDDAAVDNRILKADIETLRAKVKMSEETVKRLTGVNPLLVAMSQSQMPFVSSQMPMQSNSQ

SEQ ID NO: 333 - protein, 99 aa, Cucurbita maxima
  VARIANT (1)...(99): Xaa = Any Amino Acid
MASIPRKSSPGSNGGSQPAIPDERKRKRMQSNRESARRSRMKKQKQVEDLTGELSRLQMANNQLLQSIGAKEQAFVXVDNMNNVLRSQAIELADRLRSL

SEQ ID NO: 334 - protein, 206 aa, Cucurbita maxima
KRSASELALEEFLKKAAVISPQVTDADADADDDVFNLEREEEVIRSPKRGKNFPDSACFFGDIDFSYFLVKNNREIMDAIVNRGAGLTEATIDSQSSIVSSPTSGSNLMGRERGRGNNSGSSEDQSDDEIEAGSYEQSTDPLASKKIRRMISNRESARRSRRRKQAQLSELESQVKQLKGENETLFNQLLDASQHYHDANTNNRVL

SEQ ID NO: 335 - protein, 123 aa, Sicyos angulatus
MGTGEEGTPSKTSKPPPSSQPVQEIPPTLSYPDWTSSMQAYYGAGATPPPYFASSPTPHPYMWGGQHPMMQPYGTPVPYPAIYPHPPGGVYAHPNITVTPGSAPISAEYDGKPPDGKERASKK

SEQ ID NO: 336 - protein, 232 aa, Sicyos angulatus
KRSASELALEELLEKTTVDALKVEPDEEVSVSRSPKRSKSFQDSADACNFFRDIDFNFFFTNNPEIMDAIVNCGGGLAEGPLWAQNLTPKLSSISATIDSQSSFVSSPTSGSNMMSREHQRDNNSGSSEDQSDDEVEEPGSYGQTTDPLSLKKMRRMISNRDSARRSRRRKQAHLAELESQMNQLKVENETLFNQLLDATQQYRDANTNNRVLKSDVNAMRAKVKLAEDTLA

SEQ ID NO: 337 - protein, 166 aa, Sicyos angulatus
MDAIVNCGGGLAEGPLWAQNLTPKLSSISATIDSQSSFVSSPTSGSNMMSREHQRDNNSGSSEDQSDDEVEEPGSYGQTTDPLSLKKMRRMISNRDSARRSRRRKQAHLAELESQMNQLKVENETLFNQLLDATQQYRDANTNNRVLKSDVNAMRAKVKLAEDTLA

SEQ ID NO: 338 - protein, 258 aa, Cucumis sativus
MAVTSSPREEYVYMAKLAEQAERYEEMVEFMEKVSAAADDEELTVEERNLLSVAYKNVIGARRASWRIISSIEQKEESRGNDDHVSVIRGYRSKIETELSNICDGILKLLDSRLISSAASGDSKVFYLKMKGDYHRYLAEFKTGAERKEAAESTLTAYKSAQDIANSELAPTHPIRLGLALNFSVFYYEILNSPDRACSLAKQAFDEAIAELDTLGEESYKDSTLIMQLLRDNLTLWTSDMQDDGDEIKEAAPKRDDE

SEQ ID NO: 339 - protein, 261 aa, Cucumis sativus
MAAAPSVREENVYMAKLAEQAERYEEMVEFMEKVSASLDKEELTVEERNLLSVAYKNVIGARRASWRIISSIEQKEESRGNDDHVSVIRDYRSKIETELSNICDGILKLLDSRLIPSAASGDSKVFYLKMKGDYHRYLAEFKTGAERKEAAESTLTAYKAAQDIANSELPPTHPIRLGLALNFSVFYYEILNSPDRACSLAKQAFDEAIAELDTLGEESYKDSTLIMQLLRDNLTLWTSDMQDDGADEIKEAPPKREDEKQ

SEQ ID NO: 340 - protein, 252 aa, Cucumis sativus
MAAAVPENLSREQYVYLAKLAEQAERYEEMVQFMQKLVLGSTPGSELSVEERNLLSVAYKNVIGSLRAAWRIVSSIEQKEESRKNEEHVVLVKDYRSKVESELSDVCASILQLLDSNLIPSASASESKVFYLKMKGDYHRYLAEFKVGDERKAAAEDTMLAYRAAQDVAVADLAPTHPIRLGLALNFSVFYFEILNQSDKACSMAKEAFEEAIAELDTLGEESYKDSTLIMQLLRDNLTLWTSDAQDQLDES

SEQ ID NO: 341 - protein, 248 aa, Cucumis sativus
MAKERELLVYSAKLAEQAERYEEMVEEMKKIAKLNVELTVEERNLLSVGYKNVIGARRASWRILSSIEQKETTKHNEKNVERIIGYRHGVEDELSKICSDILSIIDQHLLPCSSAGESTVFYHKMKGDYCRYLAEFKSGDEHKQVADQSLKSYEAASAIANSDLSPTHPIRLGLALNFSVFYYEILNSPERACHLAKQAFDEAIAELDSLNEESYKDITLIMQLLRDNLTLWTSDLADEGEQSNADEL

SEQ ID NO: 342 - protein, 198 aa, Cucumis sativus
MASLIPENLTREQYVYLSKLSEQAERYEEMVDFMQKLVLTSTPASELTVEERNLLSVAYKNVIGSLRAAWRIVSSIEQKEEGRKNEDHVVLVKDYRSKVESELTEVCANILKLLDSNLIPSSSSGESEVFYLKMKGDYHRYLAEFKIGEERKSAAEDTMLAYKAAQDIAVADLAPTHPIRLGLALNFSVFYFEILNQS

SEQ ID NO: 343 - protein, 245 aa, Cucurbita maxima
MAVASSPREEYVYLAKLAEQAERYEEMVEFMEKVSAAVDNEELTVEERNLLSVAYKNVIGARRASWRIISSIEQKEESRGNDDHVSIIRDYRSKIETELSNICDGILNLLDSRLIPSAASGDSKVFYLKMKGDYHRYLAEFKTGAKRKESAESTLTAYKSAQDIANAELSPTHPIRLGLALNFSVFYYEILNSPDRACSLAKQAFDEAIAELDTLGEESYKDSTLIMQLLRDNLTLWTSDMQDDG

SEQ ID NO: 344 - protein, 230 aa, Cucurbita maxima
MATAPSLREENVYMAKLAEQAERYEEMVEFMEKVSASIDKEELTVEERNLLSVAYKNVIGARRASWRIISSIEQKEESRGNDHHVSVIRDYRSKIESELSNICDGILKLLDSRLIPSAASGDSKVFYLKMKGDYHRYLAEFKTGAERKEAAESTLTAYKAAQDIANAELPPTHPIRLGLALNFSVFYYEILNSPDRACSLAKQAFDEAIAELDTLGEESYKDSTLIMQLL

SEQ ID NO: 345 - protein, 252 aa, Cucurbita maxima
MAASVPDNLSREQYVYLAKLAEQAERYEEMVQFMQKLVLGSTPGSELSVEERNLLSVAYKNVIGSLRAAWRIVSSIEQKEESRKNEEHVVLVKDYRSKVESELSEVCASILKLLDSNLIPSACASESKVFYLKMKGDYHRYMAEFKAGDERKAAAEDAMLAYRDALDVAVADLAPTHPIRLGLALNFSVFYFEILNQSDKACSMAKEAFEEAIAELDTLGEESYKDSTLIMQLLRDNLTLWTSDAQDQLDES

SEQ ID NO: 346 - protein, 210 aa, Cucurbita maxima
MAVASSPREKYVYMAKLAEQAERYEEMVEFMEKVSAAIENEELTVEERNLLSVAYKNVIGARRASWRIISSIEQKEESRGNDDHVSVIREYRSKIESELSNICDGILKLLDSRLISSAASGDSKVFYLKMKGDYHRYLAEFKTGAERKEAAESTLTAYKSAQDIANSELAPTHPIRLGLALNFSVFYYEILNSPDRACSLAKQAFDEAIA

SEQ ID NO: 347 - protein, 264 aa, Cucurbita maxima
MSSAEKERETQVYMAKLAEQAERYDEMVEYMKNIAKLDLELTVEERNLLSVGYKNVIGARRASWRIMSSIEQKEESKGNENIVKLIKSYRQKVEEELSKICGDILSIIDKHLIPHSSAAEATVFYYKMKGDYYRYLAEFKTDQDRKEAADQSLKGYEAASGTANTELPSTHPIRLGLALNFSVFYYEIMNSPERACHLAKQAFDEAIAELDTLSEESYKDSTLIMQLLRDNLTLWTSDLPEDGGDENFKAEESKPAEPEAQQGK

SEQ ID NO: 348 - protein, 261 aa, Cucurbita maxima
MASSKERENFVYVAKLAEQAERYDEMVEAMKNVAKLEVELTVEERNLLSVGYKNVVGARRASWRILSSIEQKEEAKGNEANAKRIKEYRQKVETELSGICDDIMTVIDEHLIPLASAGESTVFYYKMKGDYYRYLAEFKSGNEKKEAADQSMKAYEAATSSAESELPPTHPIRLGLALNFSVFYYEILNSPERACHLAKQAFDEAISELDTLNEESYKDSTLIMQLLRDNLTLWTSDIPEDGDDAQKTNGTAKISGGDDAE

SEQ ID NO: 349 - protein, 260 aa, Cucurbita maxima
MASSRERENFVYIAKLAEQAERYDEMVDAMKNVAKLDVELTVEERNLLSVGYKNVVGARRASWRILSSIEQKEEAKGNETNAKRIKEYRQKVETELSGICTDIMTVIDEHLIPSASAGESTVFYYKMKGDYYRYLAEFKSGNEKKDAADQSMKAYEAATSSAESELPPTHPIRLGLALNFSVFYYEILNSPERACHLAKQAFDGAISELDTLNEESYKDSTLIMQLLRDNLTLWTSDIPEDGDDAQKVNGTVKVAGGVDE

SEQ ID NO: 350 - protein, 200 aa, Cucurbita maxima
MSTVDSSREENVYLAKLAEQAERYEEMVEFMEKVAKTVDVEELTVEERNLLSVAYKNVIGARRASWRIISSIEQKEESRGNEDHVAIIKEYRGKIETELSKICDGILSLLESHLIPSASSAESKVFYLKMKGDYHRYLAEFKTGAERKEAAESTLLAYKSAQDIALAELAPTHPIRLGLALNFSVFYYEILNSPDRACNL

SEQ ID NO: 351 - protein, 199 aa, Sicyos angulatus
MAAAAAPSVREENVYMAKLAEQAERYEEMVDFMEKVSASLDKEELTVEERNLLSVAYKNVIGARRASWRIISSIEQKEESRGNDDHVSVIRGYRSKIEKELSDICDGILKLLDSRLIPSAASGDSKVFYLKMKGDYHRYLAEFKTSAERKEAAESTLTAYKAAQDIANAELPPTHPIRLGLALNFSVFYYEILNSPDRA

SEQ ID NO: 352 - protein, 568 aa, Arabidopsis thaliana
MEHYEVLEQIGKGSFGSALLVRHKHEKKLYVLKKIRLARQTGRTRRSAHQEMELISKIRNPFIVEYKDSWVEKGCYVCIVIGYCKGGDMAEAIKKANGVEFSEEKLCKWLVQLLMALEYLHASHILHRDVKCSNIFLTKDQDIRLGDFGLAKILTSDDLASSVVGTPSYMCPELLADIPYGSKSDIWSLGCCMYEMTALKPAFKAFDMQGLINRINRSIVAPLPAQYSTAFRSLVKSMLRKNPELRPSASDLLRQPLLQPYVQKVLLKLSFREHDTLPSESERRSSYPQQRKRTSGKSVSFGPSRFGVDQEDSVSSVKPVHTYLHRHRPVDLSANDTSRVVVRRPAVSSVVSNSSKYVPVRSNQPKSGGLLKPAVVTRRASLPISQKPAKGTKDSLYHPNIGILHQLNSPDVSVNSPRIDRIKFPLASYEEMPFIPVVRKKKGSSRGSYSPPPEPPLDCSITKDKFTLEPERETKSDLSDQNATAGASSRASSGASRRQRFDPSSYRQRAEALEGLLEFSARLLIDERYDELNVLLKPFGPGKVSPRETAIWLSKSFKESSPSNLEED

SEQ ID NO: 353 - protein, 941 aa, Arabidopsis thaliana
MESRMDQYELMEQIGRGAFGAAILVHHKAERKKYVLKKIRLARQTERCRRSAHQEMSLIARVQHPYIVEFKEAWVEKGCYVCIVTGYCEGGDMAELMKKSNGVYFPEEKLCKWFTQLLLAVEYLHSNYVLHRDLKCSNIFLTKDQDVRLGDFGLAKTLKADDLTSSVVGTPNYMCPELLADIPYGFKSDIWSLGCCIYEMAAYRPAFKAFDMAGLISKKSTHQGNVKEEPRVSAKRMASEILKHPYLQPYVEQYRPTLSAASITPEKPLNSREGRRSMAESQNSNSSSEKDNFYVSDKNIRYVVPSNGNKVTETDSGFVDDEDILDHVQQSAENGNLQSVSATKPDGHGILKPVHSDQRPDVIQPRHPKTIRNIMMVLKEEKARENGSPMRSNRSRPSSVPTQKNNVETPSKIPKLGDIAHSSKTNASTPIPPSKLASDSARTPGSFPPKHHMPVIDSSPKLKPRNDRISPSPAAKHEAEEAMSVKRRQRTPPTLPRRTSLIAHQSRQLGADISNMAAKETAKLHPSVPSESETNSHQSRVHASPVSTTPEPKRTSVGSAKGMQSESSNSISSSLSMQAFELCDDASTPYIDMTEHTTPDDHRRSCHSEYSYSFPDISSEMMIRRDEHSTSMRLTEIPDSVSGVQNTIAHHQPEREQGSCPTVLKDDSPATLQSYEPNTSQHQHGDDKFTVKEFVSSVPGPAPLPLHVEPSHQVNSHSDNKTSVMSQNSALEKNNSHSHPHPVVDDVIHVIRHSSFRVGSDQPVMESVEVGVQNVDMGKLINVVRDEMEVRKGATPSESPTTRSIISEPDSRTEPRPKEPDPITNYSETKSFNSCSDSSPAETRTNSFVPEEETTPTPPVKETLDIKSFRQRAEALEGLLELSADLLEQSRLEELAIVLQPFGKNKVSPRETAIWLAKSLKGMMIEDINNNNSSGSSRNCS

SEQ ID NO: 354 - protein, 128 aa, Arabidopsis thaliana
MDLELLQDLSKFNFPTPIKIRSKTSKTKKDEGDDDEDDLRCSTPTSQEHKIPAVVDSPPPPPRKPRPPPSAPSATAALMIRSCKRKLLVSTCEIIMNREEIDRFFSSVYNETSTTAKRRRSYPYCSRR

SEQ ID NO: 355 - protein, 315 aa, Arabidopsis thaliana
MGTSEDKMPFKTTKPTSSAQEVPPTPYPDWQNSMQAYYGGGGTPNPFFPSPVGSPSPHPYMWGAQHHMMPPYGTPVPYPAMYPPGAVYAHPSMPMPPNSGPTNKEPAKDQASGKKSKGNSKKKAEGGDKALSGSGNDGASHSDESVTAGSSDENDENANQQEQGSIRKPSFGQMLADASSQSTTGEIQGSVPMKPVAPGTNLNIGMDLWSSQAGVPVKDERELKRQKRKQSNRESARRSRLRKQAECEQLQQRVESLSNENQSLRDELQRLSSECDKLKSENNSIQDELQRVLGAEAVANLEQNAAGSKDGEGTN

SEQ ID NO: 356 - protein, 407 aa, Arabidopsis thaliana
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNSSLLFFHSAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKDQLSLFPPLEGISMDNDHQEPDTNQTGAAERKVDSYKDST

SEQ ID NO: 357 - protein, 173 aa, Arabidopsis thaliana
MQPQTDVFSLHNYLNSSILQSPYPSNFPISTPFPTNGQNPYLLYGFQSPTNNPQSMSLSSNNSTSDEAEEQQTNNNIINERKQRRMISNRESARRSRMRKQRHLDELWSQVMWLRIENHQLLDKLNNLSESHDKVLQENAQLKEETFELKQVISDMQIQSPFSCFRDDIIPIE

SEQ ID NO: 358 - protein, 277 aa, Arabidopsis thaliana
MDNHTAKDIGMKRSASELALQEYLTTSPLDPCFDLMNRDYTCELRDSLLWSEGLFPAGPFRDAQSSICENLSADSPVSANKPEVRGGVRRTTSGSSHVNSDDEDAETEAGQSEMTNDPNDLKRIRRMNSNRESAKRSRRRKQEYLVDLETQVDSLKGDNSTLYKQLIDATQQFRSAGTNNRVLKSDVETLRVKVKLAEDLVARGSLTSSLNQLLQTHLSPPSHSISSLHYTGNTSPAITVHSDQSLFPGMTLSGQNSSPGLGNVSSEAVSCVSDIWP

SEQ ID NO: 359 - protein, 417 aa, Arabidopsis thaliana
MNSIFSIDDFSDPFWETPPIPLNPDSSKPVTADEVSQSQPEWTFEMFLEEISSSAVSSEPLGNNNNAIVGVSSAQSLPSVSGQNDFEDDSRFRDRDSGNLDCAAPMTTKTVIVDSDDYRRVLKNKLETECATVVSLRVGSVKPEDSTSSPETQLQPVQSSPLTQGSLMTPGELGVTSSLPAEVKKTGVSMKQVTSGSSREYSDDEDLDEENETTGSLKPEDVKKSRRMLSNRESARRSRRRKQEQTSDLETQVNDLKGEHSSLLKQLSNMNHKYDEAAVGNRILKADIETLRAKVKMAEETVKRVTGMNPMLLGRSSGHNNNNRMPITGNNRMDSSSIIPAYQPHSNLNHMSNQNIGIPTILPPRLGNNFAAPPSQTSSPLQRIRNGQNHHVTPSANPYGWNTEPQNDSAWPKKCVD

SEQ ID NO: 360 - protein, 146 aa, Arabidopsis thaliana
MGSLQMQTSPESDNDPRYATVTDERKRKRMISNRESARRSRMRKQKQLGDLINEVTLLKNDNAKITEQVDEASKKYIEMESKNNVLRAQASELTDRLRSLNSVLEMVEEISGQALDIPEIPESMQNPWQMPCPMQPIRASADMFDC

SEQ ID NO: 361 - protein, 315 aa, Arabidopsis thaliana; identical to SEQ ID NO: 92

SEQ ID NO: 362 - protein, 454 aa, Arabidopsis thaliana; identical to SEQ ID NO: 83

SEQ ID NO: 363 - protein, 259 aa, Arabidopsis thaliana
MASGREEFVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQ

SEQ ID NO: 364 - protein, 267 aa, Arabidopsis thaliana
MATPGASSARDEFVYMAKLAEQAERYEEMVEFMEKVAKAVDKDELTVEERNLLSVAYKNVIGARRASWRIISSIEQKEESRGNDDHVSLIRDYRSKIETELSDICDGILKLLDTILVPAAASGDSKVFYLKMKGDYHRYLAEFKSGQERKDAAEHTLTAYKAAQDIANSELAPTHPIRLGLALNFSVFYYEILNSPDRACNLAKQAFDEAIAELDTLGEESYKDSTLIMQLLRDNLTLWTSDMQDDVADDIKEAAPAAAKPADEQQS

SEQ ID NO: 365 - protein, 267 aa, Arabidopsis thaliana
MAAPPASSSAREEFVYLAKLAEQAERYEEMVEFMEKVAEAVDKDELTVEERNLLSVAYKNVIGARRASWRIISSIEQKEESRGNDDHVTTIRDYRSKIESELSKICDGILKLLDTRLVPASANGDSKVFYLKMKGDYHRYLAEFKTGQERKDAAEHTLTAYKAAQDIANAELAPTHPIRLGLALNFSVFYYEILNSPDRACNLAKQAFDEAIAELDTLGEESYKDSTLIMQLLRDNLTLWTSDMQDESPEEIKEAAAPKPAEEQKEI

SEQ ID NO: 366 - protein, 248 aa, Arabidopsis thaliana
MATTLSRDQYVYMAKLAEQAERYEEMVQFMEQLVSGATPAGELTVEERNLLSVAYKNVIGSLRAAWRIVSSIEQKEESRKNEEHVSLVKDYRSKVETELSSICSGILRLLDSHLIPSATASESKVFYLKMKGDYHRYLAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQEQMDEA

SEQ ID NO: 367 - protein, 263 aa, Arabidopsis thaliana
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLNEESYKDSTLIMQLLRDNLTLWTSDISEEGGDDAHKTNGSAKPGAGGDDAE

SEQ ID NO: 368 - protein, 265 aa, Arabidopsis thaliana
MSSSREENVYLAKLAEQAERYEEMVEFMEKVAKTVDTDELTVEERNLLSVAYKNVIGARRASWRIISSIEQKEESRGNDDHVSIIKDYRGKIETELSKICDGILNLLDSHLVPTASLAESKVFYLKMKGDYHRYLAEFKTGAERKEAAESTLVAYKSAQDIALADLAPTHPIRLGLALNFSVFYYEILNSPDRACSLAKQAFDEAISELDTLGEESYKDSTLIMQLLRDNLTLWNSDINDEAGGDEIKEASKHEPEEGKPAETGQ

SEQ ID NO: 369 - protein, 268 aa, Arabidopsis thaliana
MSSSGSDKERETFVYMAKLSEQAERYDEMVETMKKVARVNSELTVEERNLLSVGYKNVIGARRASWRIMSSIEQKEESKGNESNVKQIKGYRQKVEDELANICQDILTIIDQHLIPHATSGEATVFYYKMKGDYYRYLAEFKTEQERKEAAEQSLKGYEAATQAASTELPSTHPIRLGLALNFSVFYYEIMNSPERACHLAKQAFDEAIAELDTLSEESYKDSTLIMQLLRDNLTLWTSDLPEDGGEDNIKTEESKQEQAKPADATEN

SEQ ID NO: 370 - protein, 465 aa, Arabidopsis thaliana
MGTGEMGTPAKTTKASTPQEQPPTSTAMLYPDWAAAFQAYYNSGTTPPPPPAYFHSSVASSPQPHPYMWGGQPLMPPYGTLPPPYAAMYHHGSMYAHPSMPPGAHPFAPYVMTSSLSTTEGAPVGTTSGADAEGKPSEPKDQTLLKRSKGSLGSLNMLTGKINEADKGTGGGGNGALSISGESGSEGSSERSDETSQNGSEATQKKGFELNSTKAAEAQNTTTTSYNAHGGSAFGASGVQTVNATVNLAIAAVPISVAGKSATVAGSKTNLNMGMDYWSGSTTATSTMRGKRPAVPRTTAMVPAPQSISLMVPCDGVPTELWDERELKRQRRKQSNRESARRSRLRKQAECEDLAKRVDILKAENASLRKELNRLGEECKKLSTENAFLHKKLCKAPEEETRDTRSEKDGEAGTGEQHEQQNEDTDSGAVESMQRDGRREETSFNLDGKNQPLDNRNQAVSVSAG

SEQ ID NO: 371 - protein, 259 aa, Arabidopsis thaliana
MSSEKERDAHVYLAKLAEQAERYDEMVECMKKVAKLDLDLTVEERNLLSVGYKNVIGARRASWRIMSSIEQKEESKGNEHNVKLVRDYRQKVEEELSKICSDILSIIDKHLIPSSNAGEATVFYYKMKGDYYRYLAEFKIDQERKEAAEQSLKGYEAASSTANTELPSTHPIRLGLALNFSVFYYEIMNSPERACHLAKQAFDEAIAELDTLSEESYKDSTLIMQLLRDNLTLWTSDLPEDGGEDGIKVEEPKPAEPEH

SEQ ID NO: 372 - protein, 262 aa, Arabidopsis thaliana
MASTKERDGYVYVAKLAEQAERYDEMVEAMKNVAKLDVELTVEERNLLSVGYKNVIGARRASWRILSSIEQKEDSKGNEHNVKKIKEYRQKVEAELANICGDVMKVIDEHLIPSCAGGESTVFFYKMKGDYYRYLAEFKAGDDRKEAADQSMKAYELASTTAEADLSPTHPIRLGLALNFSVFYYEIMNSPERACHLAKQAFDEAISELDTLSEESYKDSTLIMQLLRDNLTLWTSDIPEDGAEDAQKLDNAAKAAGGEDAE

SEQ ID NO: 373 - protein, 555 aa, Arabidopsis thaliana
MERYEVLEQIGKGSFGSALLVRHKQERKKYVLKKIRLARQSDRARRSAHQEMELISTVRNPFVVEYKDSWVEKGCYVCIVIGYCQGGDMTDTIKRACGVHFPEEKLCQWLVQLLMALDYLHSNHILHRDVKCSNIFLTKEQDIRLGDFGLAKILTSDDLTSSVVGTPSYMCPELLADIPYGSKSDIWSLGCCMYEMAAHKPPFKASDVQTLITKIHKLIMDPIPAMYSGSFRGLIKSMLRKNPELRPSANELLNHPHLQPYISMVYMKLESPRRSTFPLQFSERDATLKERRRSSFSNDRRLNPSVSDTEAGSVSSSGKASPTPMFNGRKVSEVTVGVVREEIVPQRQEEAKKQSGAARTPRVAGTSAKASTQRTVFKHELMKVSNPTERRRRVSLPLVVENPYTYESDITALCSLNSPDVSVNTPRFDKIAEFPEDIFQNQNRETASRREVARHSFSSPPCPPHGEDNSNGSITKDKCTVQKRSVSEVKQRRFDTSSYQQRAEALEGLLEFSAKLLQQERYDELGVLLKPFGAERVSSRETAIWLTKSFKEASV

SEQ ID NO: 374 - protein, 427 aa, Arabidopsis thaliana
MANKISETASKMDDYEVVEQIGRGAFGSAFLVIHKSERRKYVVKKIRLAKQTERCKLAAIQEMSLISKLKSPYIVEYKDSWVEKDCVCIVTSYCEGGDMTQMIKKSRGVFASEEKLCRWMVQLLLAIDYLHNNRVLHRDLKCSNIFLTKENEVRLGDFGLAKLLGKDDLASSMVGTPNYMCPELLADIPYGYKSDIWSLGCCMFEVAAHQPAFKAPDMAALINKINRSSLSPLPVMYSSSLKRLIKSMLRKNPEHRPTAAELLRHPHLQPYLAQCQNLSPVFKPVVSKSEHNTNENRTGLPPKTKSAKTPIKHNQESEETEKKNKDTSSSSKDKERPAKSQEMSVISTLTLLREFQKKSPKSEERAEALESLLELCAGLLRQEKFDELEGVLKPFGDETVSSRETAIWLTKSLMNVKRKQNDDETNI

SEQ ID NO: 375 - protein, 606 aa, Arabidopsis thaliana [sequence omitted]

SEQ ID NO: 376 - protein, 170 aa, Pinus radiata
RFVEPLVVGRVIGDVLHMFVPGVDLAVTYASRQVNNGCELKPSAVALLPRVDIGGEDLRNFYTLVMTDPDAPSPSDPTLREYLHWIVTDIPATTSASFGRELVSYESPRPTIGIHRFIFVLFKQIGRQTVYPPSSRINFNTRNFARSNSLGLPVAAVYFNAQKETAGRRR

SEQ ID NO: 377 - DNA, 1468 bp, Cucurbita spp
gtttctctatctctctctctctctaaaaaacccactcacacaatcctccatcaatcccatatacataaacttttcgtttcctttctctgtttttccccctttttgtttttgtgtttttttgaaggaaattggatggtgggttgttgatttgatccaaattgctgctctccaactgctgtcttgtgttggaaatggggatttgggtagtgggtttttatgggatgagttcttcgccggcgatggggcggtgatttcaggaccatgttcctctgcgatggagtacgattctggaattccgatgtctgtgacggagggacactcctctgcccttgcaccatccttgcgcgaagatgcactttggcaaatgaacttgggatcaggtgaaataatgggatctggatcttatccagtgcgacctggagagccagactgttcttattacatcagaactggcctatgtagatttggggctacatgtagatttaatcatccacctaatagagagctggctattgccactgcaagaatgaagggggagttcccggaaagaattggacaaccagaatgtcagtactacctgaagacaggaacttgcaagtttggggccacgtgcaagtttcatcatcctagagacaaggccgggattgctggaagagttgccttaaatattttaggctatccacttcgcccgagtgaaactgaatgtgcttattatttaagaactggacaatgcaagtttggaaatacatgtaaattccaccatcctcaaccaactaatatgatggtctcattgcgtggttctcctatttatccaaccgtacaatcaccaactcctggtcagcaatcgtatccaggaggaagtacaaattggtctagggcttcatttattcccagtccacgatggcaaggtccttccagttatgcatctttaatattacctcagggagttctttctgttccaggttggaatgcattcaatgatcagctaggatcggtttcgtcttcagaaagtccacaacaaacgagggagaatgtatttcctgagaggcctggccagcctgaatgtcagttttacatgaagactggagattgcaagtttggtgctgtttgtcgatttcaccatcccagagaaagagtacttcctgctccagattgtgtcttgagtccaataggcctgccactacgtccgggagaacctttgtgcatcttttattctcgttatgggatctgtaagtttggtccaagctgcaagtttgatcaccctatgggaatcttcacatacaatctctcagcagcatcatcagccaatgccccggttcagcatttgtttgggacgtcttcgggaacaactgcactgaacctatcatctgaggggctagttgaagcaggatctgcaaagccaaggcggctatcaatctcggagagtcgagaaatgccatctgatgatgaaaatgacgctgagggctga

SEQ ID NO: 378 - DNA, 1194 bp, Cucurbita spp
atggagtacgattctggaattccgatgtctgtgacggagggacactcctctgcccttgcaccatccttgcgcgaagatgcactttggcaaatgaacttgggatcaggtgaaataatgggatctggatcttatccagtgcgacctggagagccagactgttcttattacatcagaactggcctatgtagatttggggctacatgtagatttaatcatccacctaatagagagctggctattgccactgcaagaatgaagggggagttcccggaaagaattggacaaccagaatgtcagtactacctgaagacaggaacttgcaagtttggggccacgtgcaagtttcatcatcctagagacaaggccgggattgctggaagagttgccttaaatattttaggctatccacttcgcccgagtgaaactgaatgtgcttattatttaagaactggacaatgcaagtttggaaatacatgtaaattccaccatcctcaaccaactaatatgatggtctcattgcgtggttctcctatttatccaaccgtacaatcaccaactcctggtcagcaatcgtatccaggaggaagtacaaattggtctagggcttcatttattcccagtccacgatggcaaggtccttccagttatgcatctttaatattacctcagggagttctttctgttccaggttggaatgcattcaatgatcagctaggatcggtttcgtcttcagaaagtccacaacaaacgagggagaatgtatttcctgagaggcctggccagcctgaatgtcagttttacatgaagactggagattgcaagtttggtgctgtttgtcgatttcaccatcccagagaaagagtacttcctgctccagattgtgtcttgagtccaataggcctgccactacgtccgggagaacctttgtgcatcttttattctcgttatgggatctgtaagtttggtccaagctgcaagtttgatcaccctatgggaatcttcacatacaatctctcagcagcatcatcagccaatgccccggttcagcatttgtttgggacgtcttcgggaacaactgcactgaacctatcatctgaggggctagttgaagcaggatctgcaaagccaaggcggctatcaatctcggagagtcgagaaatgccatctgatgatgaaaatgacgctgagggctga

SEQ ID NO: 379 - DNA, 1014 bp, Cucurbita maxima
ccgcgaatccacgctctgactcccacacgaccaccgccggtgacggagaatcggaaccgccgcggagaggcttgggaaacggcgagccagagatcgacttcaatggcgagcgaaggcgcttccagtgagaattttacttccataagtagagagttcaatgctctggtgatcgccggcgcggagatcggcgacggttatcgccaggaccggccgattaacgaagctccgaataacttgagcaggattggagaggaagatcaggctacgcctgaggaggagacgaatccgttggcgatcgtaccggacggtcatccgtttgatgatcaattaacgccgtcgtcaatcacgagacaggagaacagtagcggcggaggagcagcagcgacaagagagatttcgttgcagatggtgaagaaggaggaggtggagacgaagattagcgcatggcggaacgcgaagattgcaaagattaacaatcggttcaagagagaagatgcagtgatcagtggatgggagagggagcaggttcagaaggcaacttcgtggatgaagaaggttcagaggaggttggaagagaggagagcaaaagcgcttgaaaagatggagaatgaagtggcgaaggcgcgcagaaaagcagaggaaagaagagcatcagctgaagccaagaggggaacaaaagttgcgaaggtcattgaaatatcaaacttgatgagagcagttggaaggccaccagccaagcgctccttcttctgaattcctctctcttttgatgacagcagttggaattcgtctctctttgtaactaattaaggagatggataatcaaaaccctccataaacagatttacattttttcttttacttgagagaacaaaggaaagctatattatgcatcgttctctaccaagatcaaatcttggtttctggttggttttagtttaagaacttgtaagtaagaaatgggcaattagtctatgtgtttatacgagtttgtctttatcagacttcttgcaa

SEQ ID NO: 380 - DNA, 651 bp, Cucurbita maxima
atggcgagcgaaggcgcttccagtgagaattttacttccataagtagagagttcaatgctctggtgatcgccggcgcggagatcggcgacggttatcgccaggaccggccgattaacgaagctccgaataacttgagcaggattggagaggaagatcaggctacgcctgaggaggagacgaatccgttggcgatcgtaccggacggtcatccgtttgatgatcaattaacgccgtcgtcaatcacgagacaggagaacagtagcggcggaggagcagcagcgacaagagagatttcgttgcagatggtgaagaaggaggaggtggagacgaagattagcgcatggcggaacgcgaagattgcaaagattaacaatcggttcaagagagaagatgcagtgatcagtggatgggagagggagcaggttcagaaggcaacttcgtggatgaagaaggttcagaggaggttggaagagaggagagcaaaagcgcttgaaaagatggagaatgaagtggcgaaggcgcgcagaaaagcagaggaaagaagagcatcagctgaagccaagaggggaacaaaagttgcgaaggtcattgaaatatcaaacttgatgagagcagttggaaggccaccagccaagcgctccttcttctga

SEQ ID NO: 381 - protein, 397 aa, Cucurbita spp
MEYDSGIPMSVTEGHSSALAPSLREDALWQMNLGSGEIMGSGSYPVRPGEPDCSYYIRTGLCRFGATCRFNHPPNRELAIATARMKGEFPERIGQPECQYYLKTGTCKFGATCKFHHPRDKAGIAGRVALNILGYPLRPSETECAYYLRTGQCKFGNTCKFHHPQPTNMMVSLRGSPIYPTVQSPTPGQQSYPGGSTNWSRASFIPSPRWQGPSSYASLILPQGVLSVPGWNAFNDQLGSVSSSESPQQTRENVFPERPGQPECQFYMKTGDCKFGAVCRFHHPRERVLPAPDCVLSPIGLPLRPGEPLCIFYSRYGICKFGPSCKFDHPMGIFTYNLSAASSANAPVQHLFGTSSGTTALNLSSEGLVEAGSAKPRRLSISESREMPSDDENDAEG

SEQ ID NO: 382 - protein, 216 aa, Cucurbita maxima
MASEGASSENFTSISREFNALVIAGAEIGDGYRQDRPINEAPNNLSRIGEEDQATPEEETNPLAIVPDGHPFDDQLTPSSITRQENSSGGGAAATREISLQMVKKEEVETKISAWRNAKIAKINNRFKREDAVISGWEREQVQKATSWMKKVQRRLEERRAKALEKMENEVAKARRKAEERRASAEAKRGTKVAKVIEISNLMRAVGRPPAKRSFF

SEQ ID NO: 383 - DNA, 20 bp, Arabidopsis thaliana
tcccaaatgtagacaaagca

SEQ ID NO: 384 - DNA, 110 bp, Arabidopsis thaliana
gagtaacacgtcatctctgtgcttctttgtctacaattttggaaaaagtgatgacgccattgctctttcccaaatgtagacaaagcaataccgtgatgatgtcgtggaga

SEQ ID NO: 385 - DNA, 25 bp, Artificial Sequence
  Made in the lab
gagtaacacgtcatctctgtgcttc

SEQ ID NO: 386 - DNA, 25 bp, Artificial Sequence
  Made in the lab
tctccacgacatcatcacggtattg

SEQ ID NO: 387 - DNA, 21 bp, Arabidopsis thaliana
tgattgagccgcgccaatatc

SEQ ID NO: 388 - DNA, 175 bp, Arabidopsis thaliana
gatatccgcactttaagcatgagagagtccctttgatattggcctggttcactcagatcttacctgaccacacacgtagatatacattattctctctagattatctgattgagccgcgccaatatctcagtactctctcgtctctattttggactttgtggtcttgtagatcgat

SEQ ID NO: 389 - DNA, 27 bp, Artificial Sequence
  Made in the lab
gatatccgcactttaagcatgagagag

SEQ ID NO: 390 - DNA, 26 bp, Artificial Sequence
  Made in the lab
atcgatctacaagaccacaaagtcca

SEQ ID NO: 391 - DNA, 168 bp, Arabidopsis thaliana
cttgatctgctacggtgaagtctatggtgcaccggcatctgatgaagctgccagcatgatctaattagctttctttatcctttgttgtgtttcatgacgatggttaagagatcagtctcgattagatcatgttcgcagtttcacccgttgactgtcgcacccttctat

SEQ ID NO: 392 - DNA, 28 bp, Artificial Sequence
  Made in the lab
cttgatctgctacggtgaagtctatggt

SEQ ID NO: 393 - DNA, 25 bp, Artificial Sequence
  Made in the lab
atagaagggtgcgacagtcaacggg

SEQ ID NO: 394 - DNA, 340 bp, Arabidopsis thaliana
tgagttagtcaaagcagatccacacgattatatagaaaaacaaaggaagaagaagaggaagagctccttgaagttcaatggagggtttagcagggtgaagtaaagctgctaagctatggatcccataagccttatcaaattcaatataattgatgataaggttttttttatggatgccatatctcaggagctttcacttacccctttaatggcttcactcttctttggattgaagggagctcttcatctctccatccctatctctctctctctctatctttagttcttttaagaatgacttttcattttttgtgttgtctgttgcaggtgtataaacatg

SEQ ID NO: 395 - DNA, 26 bp, Artificial Sequence
  Made in the lab
tgagttagtcaaagcagatccacacg

SEQ ID NO: 396 - DNA, 27 bp, Artificial Sequence
  Made in the lab
catgtttatacacctgcaacagacaac

SEQ ID NO: 397 - DNA, 21 bp, Arabidopsis thaliana
tgattgagccgcgccaatatc

SEQ ID NO: 398 - DNA, 1865 bp, Arabidopsis thaliana
gctcaagtgtgcaatatacatcacaatacctttgtccttgtttcaggtctacttttacatcatagaacttgctcctatagataatacaatgcatggtattgacgtaagaactcttagcttttcatattagtagcttataatgttccttaaatgcgacattgatattaagctactactcaataactcaatggtaacgaatcataagtctgaactattcgaaaacagtaatcctgaaaagaaagaatgaagcgtgttgataagtaatgatatgatttgatattgcaagtcaagaaaatataattgggtagagaaagaaagagagataatgtgtgttctgcataaaatttatggcaatggtggaccggagaggttaatgtagtaagaaagcatgagagaagtaaataggggttgcaaaagtttttgccatcccaccagtcctaaccagacaaaaaagaaaggtgttggttttaaacaagctctggtgttacaatgtgacattaaaacacgaatcttttctcttgagaatcatcaatagagagagagagtgagtggtcatattagggttcataacttgcttgaggttttgtaaaaagcagagaaagagagagagaggggcctagaaagaaagaaagaaaagcagtaagagactattaaatgttgcaggcaggtccagccagtgtcccctctcttctgcgagattccctcaaaatttattacaaagcatcttcatcgatgttcttttaattcttcctcaaaatcttttctctttttttggttatatatatttgaattttgatttatgaacctcctcaagaaggaaagacagaggaggagacaaagaagtataggttcacattgcatagccagtttagttttgaaggatggatatatgaaaaaaatatgaagagagagaagagagaagaagaggaggattaaagagggtgaggccagcttttgtgctttggtagtagatgaggtttaaatgctccataccttccatttccttctctcttaccctaatttaattcttcctctcctttataactccccacagacattctcacttctcctcctcacacttcacatcaacacttctttcttgttttttcattttacaatgtttcctttgatatccgcactttaagcatgagagagtccctttgatattggcctggttcactcagatcttacctgaccacacacgtagatatacattattctctctagattatctgattgagccgcgccaatatctcagtactctctcgtctctattttggactttgtggtcttgtagatcgatttgtatgtgtgtgttgaaatggagacaagtacttgtaacttctttgttgttatattgtttacctataggctgatgtcataaactcttttgatcttgtttctaacttccagattcttgaaaaatcaagtcgtgtgtgtgtctccatggaagccttttccatttcttcttttccaaggtatccccttaatcagcttccttgccaagtataaatctgttgtagggttttgcttcaaataatctatatggatccttttagaatgcatattgtgttgataccaattttgagacagaatgtgtcagcgaaactgatcttgtttattagtacaaatgcaggatgttagagagttagctaataacatatacaacaaaatcacaaaaccggtgaagcaatgtaaaatgtcacaatcacaagatgtttttttcaaaaacaggggaaaaagcagagttaatgagagagaagctgacgagcacgaaccctaacctgcaagcgagcaagagcatgcatacaatgtaaagcaattcgtgcttgtctcctcacaagcactcctctagccaccgcctg

SEQ ID NO: 399 - DNA, 30 bp, Artificial Sequence
  Made in the lab
gctcaagtgtgcaatatacatcacaatacc

SEQ ID NO: 400 - DNA, 22 bp, Artificial Sequence
  Made in the lab
caggcggtggctagaggagtgc

SEQ ID NO: 401 - DNA, 22 bp, Arabidopsis thaliana
atcggctggcggactggtcaac

SEQ ID NO: 402 - DNA, 2934 bp, Arabidopsis thaliana
cacatcaacaaccactaccacaataccaaaaaccctgctaattctaataagcaatctttgttactcgagaaagtgatatatacatatatacaatgaaaaccactctacgtaattaattttttgccataacaatataaaaagattgttgcatacgtttctatcagtttttatttcacatttaatcatatatgaagaacggtaattatacaaatagagaaatcatatttagatagataggagaaagctaaatagataaggactataaagtatatacatcatataatctaactattattacaagttatatctcaatatcaatatgttcttcaccatcgtttgatagtgcagttccgaaacagtaaaccatcggctggcggactggtcaactgaagctgataactcccttttagccaatatgaatagtaaataaacccaagaaccactttcactttgaatttacataataacttaataaaagaaaaaaaaaaaaactatgatagaaaaattagcatattcttccattagtttcgcaaatgcgccgacaacgtttttgacttcaaaaacaaaagtagaactcgtgtgtgaaaagcaagattctttcctttctggtataatgttctaatttgtaattaaaatatcgaatattgcttctgaaaggatcatatgtataaatctgacccaaaaaaaaaagctatatttcttagaacatgtttcatgcatgaacgtaaaaagaaaaaaaaaatagacaacatgaatattacggaagggaataaaaagctgaacatataatgaacaagatatagaaaggatttattaaaggacgaagaaaaggagtgaaaattatggattcatttggtgtcaacagataatgtataaagtagagtacttgagtatgttaaaaaaagactaccagagttaaatgacatcataaatgaaactaaaaacagtttgagtttcaatccaaaaatagagtacttgagacttgagaggtagttgaaaaagagttaattaacatcaatgaaatgaagttataaacaagtttgagtttcgatctaaaaactaggatttggaactaaaatttgcctctgaaattattggagtaaaacggtgcaacgacggcgagtggcagatcctttggtagaatagaaggaatgaccacgtgtggttggttgttgtcatcactattatgatttccctcgtaaagccatatttcattatcattgtccccatcttatttcacttcatacatacctagaaacacaaaaatgtctacttacacacatttcagcatatatatcacattttgtatatacataatttaaataataaaccactccaacttttatgaattggaaagggaacataatcaaaaattataccaaaccagagtttctaaaggataaacattttgtggtaaagataaaactaaatagaagtcatactttaaagaaatggagaatagcaattgatttaacatgatacaatctttttttttgaaaaaacatgttacaacgatgaaatagataaagatgtcaaagtttatgctgacaaaatcttttttaaaaagagggtaaaataagtttaacatgaaggtatgagatcaaaaggttatgagtaaaattttctttctatgaaacagcttaacttaataaaatacatatcaaattaaaaaaaaaaagacattgacatatatatcatcgatgtaacacatcaaccaccatctttcttgagagttttcttgttcgtgtgaggagaactaagatgtgttttgaatggaaggaacgaagatgtgagttttaaacacaatcacaatgttttactatggttttgcttatgttttgctatggttttacgtatgttttctttatatttttaatattatcttttaaatatagttcttccaaaaatttcactttcccaaaatatatttaattagtataagaatttatagtttcaattttatagtacatgcccgcctattttatagtatatttaactgtgactttgattatctatcatgtcgtcagtccaagaagccatgttatctaagtttctaacgcaaagcttaacagcttcctcttcggttcacctgaaccgtcaatttcgacggcgatatgttgttgcagttaaacttcaccaacccgaacaagaaaatcagtgtgatgtttgagaaagtttcggtaaaaatattgtttaccgacgaaatgattgccacacaaggtatcttgccgttttcgctaagaaacaacacgactaggctacaaacgatccatttggttgcaaagccgatcttcttgcctataaatgatatggttgagctcagaagacaagtgacgagcaacatgattgaatatgaaatcataagtagattcagagtaaaagttgttattgggtatattaactattcgtattggttaaaagggagttgtcaacttcagttgaccagtccgccagccgatgacttactgtctcggaagtatacactacagaaatatgatgaagaatgtatgatgggtgatatatatataaatattgatatataactcataatactatttagattatgatgtatatctaattagctttcctctatctatccaaatatgatttctcttcttataaaattattgttcttcatatatgattaaatgtgaaattatcacataaactgatagaatcgtacgcaacaatctttttatattgttatggcaaaaaactaagttttgcatatgttttgctttcgtttctaatattatttttaaatctaatttttccaaaaagttcactctcccaaaatatatatataagtagtttaaaaattgtaggtttcaattttagagatatgttagtaatttttttattaaactagagaattgaaaaataaaaactctcgtatataaaccgttacagacacaccgcacgtcacttgagtgt

SEQ ID NO: 403 - DNA, 28 bp, Artificial Sequence
  Made in the lab
cacatcaacaaccactaccacaatacca

SEQ ID NO: 404 - DNA, 27 bp, Artificial Sequence
  Made in the lab
acactcaagtgacgtgcggtgtgtctg

SEQ ID NO: 405 - DNA, 528 bp, Arabidopsis thaliana; identical to SEQ ID NO: 198

SEQ ID NO: 406 - DNA, 30 bp, Arabidopsis thaliana
atgtctataaatataagagaccctcttata

SEQ ID NO: 407 - DNA, 345 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgca

SEQ ID NO: 408 - DNA, 33 bp, Arabidopsis thaliana
atgtctataaatataagagaccctcttatagta

SEQ ID NO: 409 - DNA, 36 bp, Arabidopsis thaliana
atgtctataaatataagagaccctcttatagtaagc

SEQ ID NO: 410 - DNA, 417 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgc

SEQ ID NO: 411 - DNA, 39 bp, Arabidopsis thaliana
atgtctataaatataagagaccctcttatagtaagcaga

SEQ ID NO: 412 - DNA, 42 bp, Arabidopsis thaliana
atgtctataaatataagagaccctcttatagtaagcagagtt

SEQ ID NO: 413 - DNA, 459 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctc

SEQ ID NO: 414 - DNA, 462 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggc

SEQ ID NO: 415 - DNA, 465 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggcctt

SEQ ID NO: 416 - DNA, 468 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttccc

SEQ ID NO: 417 - DNA, 471 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtg

SEQ ID NO: 418 - DNA, 474 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggcc

SEQ ID NO: 419 - DNA, 477 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgca

SEQ ID NO: 420 - DNA, 45 bp, Arabidopsis thaliana
atgtctataaatataagagaccctcttatagtaagcagagttgtt

SEQ ID NO: 421 - DNA, 480 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagtt

SEQ ID NO: 422 - DNA, 483 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttc

SEQ ID NO: 423 - DNA, 486 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctac

SEQ ID NO: 424 - DNA, 489 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaat

SEQ ID NO: 425 - DNA, 492 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgt

SEQ ID NO: 426 - DNA, 495 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcag

SEQ ID NO: 427 - DNA, 498 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagg

SEQ ID NO: 428 - DNA, 501 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggag

SEQ ID NO: 429 - DNA, 504 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagt

SEQ ID NO: 430 - DNA, 507 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggc

SEQ ID NO: 431 - DNA, 48 bp, Arabidopsis thaliana
atgtctataaatataagagaccctcttatagtaagcagagttgttgga

SEQ ID NO: 432 - DNA, 510 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgc

SEQ ID NO: 433 - DNA, 513 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcgga

SEQ ID NO: 434 - DNA, 516 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggagga

SEQ ID NO: 435 - DNA, 519 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaaga

SEQ ID NO: 436 - DNA, 522 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaaga

SEQ ID NO: 437 - DNA, 51 bp, Arabidopsis thaliana
atgtctataaatataagagaccctcttatagtaagcagagttgttggagac

SEQ ID NO: 438 - DNA, 54 bp, Arabidopsis thaliana
atgtctataaatataagagaccctcttatagtaagcagagttgttggagacgtt

SEQ ID NO: 439 - DNA, 57 bp, Arabidopsis thaliana
atgtctataaatataagagaccctcttatagtaagcagagttgttggagacgttctt

SEQ ID NO: 440 - DNA, 60 bp, Arabidopsis thaliana
atgtctataaatataagagaccctcttatagtaagcagagttgttggagacgttcttgat

SEQ ID NO: 441 - DNA, 63 bp, Arabidopsis thaliana
atgtctataaatataagagaccctcttatagtaagcagagttgttggagacgttcttgatccg

SEQ ID NO: 442 - DNA, 66 bp, Arabidopsis thaliana
atgtctataaatataagagaccctcttatagtaagcagagttgttggagacgttcttgatccgttt

SEQ ID NO: 443 - DNA, 69 bp, Arabidopsis thaliana
atgtctataaatataagagaccctcttatagtaagcagagttgttggagacgttcttgatccgtttaat

SEQ ID NO: 444 - DNA, 72 bp, Arabidopsis thaliana
atgtctataaatataagagaccctcttatagtaagcagagttgttggagacgttcttgatccgtttaataga

SEQ ID NO: 445 - DNA, 75 bp, Arabidopsis thaliana
atgtctataaatataagagaccctcttatagtaagcagagttgttggagacgttcttgatccgtttaatagatca

SEQ ID NO: 446 - DNA, 78 bp, Arabidopsis thaliana
atgtctataaatataagagaccctcttatagtaagcagagttgttggagacgttcttgatccgtttaatagatcaatc

SEQ ID NO: 447 - DNA, 81 bp, Arabidopsis thaliana
atgtctataaatataagagaccctcttatagtaagcagagttgttggagacgttcttgatccgtttaatagatcaatcact

SEQ ID NO: 448 - DNA, 18 bp, Arabidopsis thaliana
atgtctataaatataaga

SEQ ID NO: 449 - DNA, 21 bp, Arabidopsis thaliana
atgtctataaatataagagac

SEQ ID NO: 450 - DNA, 267 bp, Arabidopsis thaliana
atgtctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttg

SEQ ID NO: 451 - DNA, 24 bp, Arabidopsis thaliana
atgtctataaatataagagaccct

SEQ ID NO: 452 - DNA, 27 bp, Arabidopsis thaliana
atgtctataaatataagagaccctctt

SEQ ID NO: 453 - DNA, 498 bp, Arabidopsis thaliana
gtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 454 - DNA, 495 bp, Arabidopsis thaliana
agcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 455 - DNA, 492 bp, Arabidopsis thaliana
agagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 456 - DNA, 489 bp, Arabidopsis thaliana
gttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 457 - DNA, 486 bp, Arabidopsis thaliana
gttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 458 - DNA, 483 bp, Arabidopsis thaliana
ggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 459 - DNA, 480 bp, Arabidopsis thaliana
gacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 460 - DNA, 477 bp, Arabidopsis thaliana
gttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 461 - DNA, 474 bp, Arabidopsis thaliana
cttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 462 - DNA, 471 bp, Arabidopsis thaliana
gatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 463 - DNA, 525 bp, Arabidopsis thaliana
tctataaatataagagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 464 - DNA, 468 bp, Arabidopsis thaliana
ccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 465 - DNA, 465 bp, Arabidopsis thaliana
tttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 466 - DNA, 462 bp, Arabidopsis thaliana
aatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 467 - DNA, 459 bp, Arabidopsis thaliana
agatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 468 - DNA, 456 bp, Arabidopsis thaliana
tcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 469 - DNA, 453 bp, Arabidopsis thaliana
atcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 470 - DNA, 450 bp, Arabidopsis thaliana
actctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 471 - DNA, 447 bp, Arabidopsis thaliana
ctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 472 - DNA, 444 bp, Arabidopsis thaliana
aaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 473 - DNA, 441 bp, Arabidopsis thaliana
gttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 474 - DNA, 414 bp, Arabidopsis thaliana
aatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 475 - DNA, 381 bp, Arabidopsis thaliana
aacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 476 - DNA, 513 bp, Arabidopsis thaliana
agagaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 477 - DNA, 348 bp, Arabidopsis thaliana
ctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 478 - DNA, 510 bp, Arabidopsis thaliana
gaccctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 479 - DNA, 507 bp, Arabidopsis thaliana
cctcttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 480 - DNA, 504 bp, Arabidopsis thaliana
cttatagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 481 - DNA, 231 bp, Arabidopsis thaliana
acctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 482 - DNA, 501 bp, Arabidopsis thaliana
atagtaagcagagttgttggagacgttcttgatccgtttaatagatcaatcactctaaaggttacttatggccaaagagaggtgactaatggcttggatctaaggccttctcaggttcaaaacaagccaagagttgagattggtggagaagacctcaggaacttctatactttggttatggtggatccagatgttccaagtcctagcaaccctcacctccgagaatatctccattggttggtgactgatatccctgctacaactggaacaacctttggcaatgagattgtgtgttacgaaaatccaagtcccactgcaggaattcatcgtgtcgtgtttatattgtttcgacagcttggcaggcaaacagtgtatgcaccagggtggcgccagaacttcaacactcgcgagtttgctgagatctacaatctcggccttcccgtggccgcagttttctacaattgtcagagggagagtggctgcggaggaagaagactttag

SEQ ID NO: 483 - protein, 175 aa, Arabidopsis thaliana; identical to SEQ ID NO: 231

SEQ ID NO: 484 - protein, 10 aa, Arabidopsis thaliana
MSINIRDPLI

SEQ ID NO: 485 - protein, 115 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTA

SEQ ID NO: 486 - protein, 11 aa, Arabidopsis thaliana
MSINIRDPLIV

SEQ ID NO: 487 - protein, 12 aa, Arabidopsis thaliana
MSINIRDPLIVS

SEQ ID NO: 488 - protein, 139 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWR

SEQ ID NO: 489 - protein, 13 aa, Arabidopsis thaliana
MSINIRDPLIVSR

SEQ ID NO: 490 - protein, 14 aa, Arabidopsis thaliana
MSINIRDPLIVSRV

SEQ ID NO: 491 - protein, 153 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNL

SEQ ID NO: 492 - protein, 154 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLG

SEQ ID NO: 493 - protein, 155 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGL

SEQ ID NO: 494 - protein, 156 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLP

SEQ ID NO: 495 - protein, 157 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPV

SEQ ID NO: 496 - protein, 158 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVA

SEQ ID NO: 497 - protein, 159 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAA

SEQ ID NO: 498 - protein, 15 aa, Arabidopsis thaliana
MSINIRDPLIVSRVV

SEQ ID NO: 499 - protein, 160 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAV

SEQ ID NO: 500 - protein, 161 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVF

SEQ ID NO: 501 - protein, 162 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFY

SEQ ID NO: 502 - protein, 163 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYN

SEQ ID NO: 503 - protein, 164 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNC

SEQ ID NO: 504 - protein, 165 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQ

SEQ ID NO: 505 - protein, 166 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQR

SEQ ID NO: 506 - protein, 167 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRE

SEQ ID NO: 507 - protein, 168 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRES

SEQ ID NO: 508 - protein, 169 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESG

SEQ ID NO: 509 - protein, 16 aa, Arabidopsis thaliana
MSINIRDPLIVSRVVG

SEQ ID NO: 510 - protein, 170 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGC

SEQ ID NO: 511 - protein, 171 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCG

SEQ ID NO: 512 - protein, 172 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGG

SEQ ID NO: 513 - protein, 173 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGR

SEQ ID NO: 514 - protein, 174 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRR

SEQ ID NO: 515 - protein, 17 aa, Arabidopsis thaliana
MSINIRDPLIVSRVVGD

SEQ ID NO: 516 - protein, 18 aa, Arabidopsis thaliana
MSINIRDPLIVSRVVGDV

SEQ ID NO: 517 - protein, 19 aa, Arabidopsis thaliana
MSINIRDPLIVSRVVGDVL

SEQ ID NO: 518 - protein, 20 aa, Arabidopsis thaliana
MSINIRDPLIVSRVVGDVLD

SEQ ID NO: 519 - protein, 21 aa, Arabidopsis thaliana
MSINIRDPLIVSRVVGDVLDP

SEQ ID NO: 520 - protein, 22 aa, Arabidopsis thaliana
MSINIRDPLIVSRVVGDVLDPF

SEQ ID NO: 521 - protein, 23 aa, Arabidopsis thaliana
MSINIRDPLIVSRVVGDVLDPFN

SEQ ID NO: 522 - protein, 24 aa, Arabidopsis thaliana
MSINIRDPLIVSRVVGDVLDPFNR

SEQ ID NO: 523 - protein, 25 aa, Arabidopsis thaliana
MSINIRDPLIVSRVVGDVLDPFNRS

SEQ ID NO: 524 - protein, 26 aa, Arabidopsis thaliana
MSINIRDPLIVSRVVGDVLDPFNRSI

SEQ ID NO: 525 - protein, 27 aa, Arabidopsis thaliana
MSINIRDPLIVSRVVGDVLDPFNRSIT

SEQ ID NO: 526 - protein, 6 aa, Arabidopsis thaliana
MSINIR

SEQ ID NO: 527 - protein, 7 aa, Arabidopsis thaliana
MSINIRD

SEQ ID NO: 528 - protein, 89 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWL

SEQ ID NO: 529 - protein, 8 aa, Arabidopsis thaliana
MSINIRDP

SEQ ID NO: 530 - protein, 9 aa, Arabidopsis thaliana
MSINIRDPL

SEQ ID NO: 531 - protein, 165 aa, Arabidopsis thaliana
VSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 532 - protein, 164 aa, Arabidopsis thaliana
SRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 533 - protein, 163 aa, Arabidopsis thaliana
RVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 534 - protein, 162 aa, Arabidopsis thaliana
VVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 535 - protein, 161 aa, Arabidopsis thaliana
VGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 536 - protein, 160 aa, Arabidopsis thaliana
GDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 537 - protein, 159 aa, Arabidopsis thaliana
DVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 538 - protein, 158 aa, Arabidopsis thaliana
VLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 539 - protein, 157 aa, Arabidopsis thaliana
LDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 540 - protein, 156 aa, Arabidopsis thaliana
DPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 541 - protein, 174 aa, Arabidopsis thaliana
SINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 542 - protein, 155 aa, Arabidopsis thaliana
PFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 543 - protein, 154 aa, Arabidopsis thaliana
FNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 544 - protein, 153 aa, Arabidopsis thaliana
NRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 545 - protein, 152 aa, Arabidopsis thaliana
RSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 546 - protein, 151 aa, Arabidopsis thaliana
SITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 547 - protein, 150 aa, Arabidopsis thaliana
ITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 548 - protein, 149 aa, Arabidopsis thaliana
TLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 549 - protein, 148 aa, Arabidopsis thaliana
LKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 550 - protein, 147 aa, Arabidopsis thaliana
KVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 551 - protein, 146 aa, Arabidopsis thaliana
VTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 552 - protein, 137 aa, Arabidopsis thaliana
NGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 553 - protein, 126 aa, Arabidopsis thaliana
NKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 554 - protein, 170 aa, Arabidopsis thaliana
RDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 555 - protein, 115 aa, Arabidopsis thaliana
LRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 556 - protein, 169 aa, Arabidopsis thaliana
DPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 557 - protein, 168 aa, Arabidopsis thaliana
PLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 558 - protein, 167 aa, Arabidopsis thaliana
LIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 559 - protein, 76 aa, Arabidopsis thaliana
TFGNEIVCYENPSPTAGIHRVVFILFRQLGRQTVYAPGWRQNFNTREFAEIYNLGLPVAAVFYNCQRESGCGGRRL

SEQ ID NO: 560 - protein, 166 aa, Arabidopsis thaliana
IVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 561 - DNA, 543 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 562 - DNA, 306 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaa

SEQ ID NO: 563 - DNA, 30 bp, Cucurbita maxima
atgccgagaaatcgtgaccctctagtcgtc

SEQ ID NO: 564 - DNA, 33 bp, Cucurbita maxima
atgccgagaaatcgtgaccctctagtcgtcggg

SEQ ID NO: 565 - DNA, 36 bp, Cucurbita maxima
atgccgagaaatcgtgaccctctagtcgtcgggaga

SEQ ID NO: 566 - DNA, 408 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctggg

SEQ ID NO: 567 - DNA, 39 bp, Cucurbita maxima
atgccgagaaatcgtgaccctctagtcgtcgggagagtg

SEQ ID NO: 568 - DNA, 42 bp, Cucurbita maxima
atgccgagaaatcgtgaccctctagtcgtcgggagagtgatc

SEQ ID NO: 569 - DNA, 450 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttac

SEQ ID NO: 570 - DNA, 453 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaat

SEQ ID NO: 571 - DNA, 456 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatctt

SEQ ID NO: 572 - DNA, 459 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggt

SEQ ID NO: 573 - DNA, 462 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcg

SEQ ID NO: 574 - DNA, 465 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgcca

SEQ ID NO: 575 - DNA, 468 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtc

SEQ ID NO: 576 - DNA, 471 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgcc

SEQ ID NO: 577 - DNA, 474 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgcc

SEQ ID NO: 578 - DNA, 477 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtc

SEQ ID NO: 579 - DNA, 45 bp, Cucurbita maxima
atgccgagaaatcgtgaccctctagtcgtcgggagagtgatcggc

SEQ ID NO: 580 - DNA, 480 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctat

SEQ ID NO: 581 - DNA, 483 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttc

SEQ ID NO: 582 - DNA, 486 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaat

SEQ ID NO: 583 - DNA, 489 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgc

SEQ ID NO: 584 - DNA, 492 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaa

SEQ ID NO: 585 - DNA, 495 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagg

SEQ ID NO: 586 - DNA, 498 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaa

SEQ ID NO: 587 - DNA, 501 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaat

SEQ ID NO: 588 - DNA, 504 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggc

SEQ ID NO: 589 - DNA, 507 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctcc

SEQ ID NO: 590 - DNA, 48 bp, Cucurbita maxima
atgccgagaaatcgtgaccctctagtcgtcgggagagtgatcggcgac

SEQ ID NO: 591 - DNA, 510 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggt

SEQ ID NO: 592 - DNA, 513 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtgga

SEQ ID NO: 593 - DNA, 51 bp, Cucurbita maxima
atgccgagaaatcgtgaccctctagtcgtcgggagagtgatcggcgacgtc

SEQ ID NO: 594 - DNA, 54 bp, Cucurbita maxima
atgccgagaaatcgtgaccctctagtcgtcgggagagtgatcggcgacgtcgtc

SEQ ID NO: 595 - DNA, 57 bp, Cucurbita maxima
atgccgagaaatcgtgaccctctagtcgtcgggagagtgatcggcgacgtcgtcgac

SEQ ID NO: 596 - DNA, 60 bp, Cucurbita maxima
atgccgagaaatcgtgaccctctagtcgtcgggagagtgatcggcgacgtcgtcgactcg

SEQ ID NO: 597 - DNA, 63 bp, Cucurbita maxima
atgccgagaaatcgtgaccctctagtcgtcgggagagtgatcggcgacgtcgtcgactcgttc

SEQ ID NO: 598 - DNA, 66 bp, Cucurbita maxima
atgccgagaaatcgtgaccctctagtcgtcgggagagtgatcggcgacgtcgtcgactcgttctcg

SEQ ID NO: 599 - DNA, 69 bp, Cucurbita maxima
atgccgagaaatcgtgaccctctagtcgtcgggagagtgatcggcgacgtcgtcgactcgttctcgagg

SEQ ID NO: 600 - DNA, 72 bp, Cucurbita maxima
atgccgagaaatcgtgaccctctagtcgtcgggagagtgatcggcgacgtcgtcgactcgttctcgaggtcc

SEQ ID NO: 601 - DNA, 9 bp, Cucurbita maxima
atgccgaga

SEQ ID NO: 602 - DNA, 12 bp, Cucurbita maxima
atgccgagaaat

SEQ ID NO: 603 - DNA, 15 bp, Cucurbita maxima
atgccgagaaatcgt

SEQ ID NO: 604 - DNA, 18 bp, Cucurbita maxima
atgccgagaaatcgtgac

SEQ ID NO: 605 - DNA, 21 bp, Cucurbita maxima
atgccgagaaatcgtgaccct

SEQ ID NO: 606 - DNA, 258 bp, Cucurbita maxima
atgccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcat

SEQ ID NO: 607 - DNA, 24 bp, Cucurbita maxima
atgccgagaaatcgtgaccctcta

SEQ ID NO: 608 - DNA, 27 bp, Cucurbita maxima
atgccgagaaatcgtgaccctctagtc

SEQ ID NO: 609 - DNA, 513 bp, Cucurbita maxima
gggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 610 - DNA, 510 bp, Cucurbita maxima
agagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 611 - DNA, 507 bp, Cucurbita maxima
gtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 612 - DNA, 504 bp, Cucurbita maxima
atcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 613 - DNA, 501 bp, Cucurbita maxima
ggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 614 - DNA, 498 bp, Cucurbita maxima
gacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 615 - DNA, 495 bp, Cucurbita maxima
gtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 616 - DNA, 492 bp, Cucurbita maxima
gtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 617 - DNA, 489 bp, Cucurbita maxima
gactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 618 - DNA, 486 bp, Cucurbita maxima
tcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 619 - DNA, 540 bp, Cucurbita maxima
ccgagaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 620 - DNA, 483 bp, Cucurbita maxima
ttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 621 - DNA, 480 bp, Cucurbita maxima
tcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 622 - DNA, 477 bp, Cucurbita maxima
aggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 623 - DNA, 474 bp, Cucurbita maxima
tccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 624 - DNA, 471 bp, Cucurbita maxima
atctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 625 - DNA, 468 bp, Cucurbita maxima
tcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 626 - DNA, 465 bp, Cucurbita maxima
attagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 627 - DNA, 537 bp, Cucurbita maxima
agaaatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 628 - DNA, 438 bp, Cucurbita maxima
gttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 629 - DNA, 534 bp, Cucurbita maxima
aatcgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 630 - DNA, 405 bp, Cucurbita maxima
gctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 631 - DNA, 531 bp, Cucurbita maxima
cgtgaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 632 - DNA, 528 bp, Cucurbita maxima
gaccctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 633 - DNA, 342 bp, Cucurbita maxima
atggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 634 - DNA, 525 bp, Cucurbita maxima
cctctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 635 - DNA, 522 bp, Cucurbita maxima
ctagtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 636 - DNA, 519 bp, Cucurbita maxima
gtcgtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 637 - DNA, 255 bp, Cucurbita maxima
gaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 638 - DNA, 516 bp, Cucurbita maxima
gtcgggagagtgatcggcgacgtcgtcgactcgttctcgaggtccatctcgattagggttgtttacgactcgagggaagttaacaatgggtgtgagctcaaaccctctcaagctgtcaacaagccaagagttgagattggtggcactgaccttcgcaccttcttcactttggttatggtggatcccgacgctcctagccctagcgatcccaatctaagagaatacttgcattggttagtgaccgatattccagctacaaccgaggcaacctttggacaagagatagtgtgctacgagaatccaagaccaacggtgggtatccaccgttttgtgctggtcttgttccggcagctcggaaggcaaacggtgtatgctcctgggtggcgccagaacttcaacaccagacactttgcagagctttacaatcttggttcgccagtcgccgccgtctatttcaattgccaaagggaaaatggctccggtggaaggagaagagccggcgatgaatgttcataa

SEQ ID NO: 639 - protein, 180 aa, Cucurbita maxima; identical to SEQ ID NO: 165

SEQ ID NO: 640 - protein, 102 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQ

SEQ ID NO: 641 - protein, 10 aa, Cucurbita maxima
MPRNRDPLVV

SEQ ID NO: 642 - protein, 11 aa, Cucurbita maxima
MPRNRDPLVVG

SEQ ID NO: 643 - protein, 12 aa, Cucurbita maxima
MPRNRDPLVVGR

SEQ ID NO: 644 - protein, 136 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPG

SEQ ID NO: 645 - protein, 13 aa, Cucurbita maxima
MPRNRDPLVVGRV

SEQ ID NO: 646 - protein, 14 aa, Cucurbita maxima
MPRNRDPLVVGRVI

SEQ ID NO: 647 - protein, 150 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELY

SEQ ID NO: 648 - protein, 151 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYN

SEQ ID NO: 649 - protein, 152 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNL

SEQ ID NO: 650 - protein, 153 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLG

SEQ ID NO: 651 - protein, 154 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGS

SEQ ID NO: 652 - protein, 155 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSP

SEQ ID NO: 653 - protein, 156 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPV

SEQ ID NO: 654 - protein, 157 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVA

SEQ ID NO: 655 - protein, 158 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAA

SEQ ID NO: 656 - protein, 159 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAV

SEQ ID NO: 657 - protein, 15 aa, Cucurbita maxima
MPRNRDPLVVGRVIG

SEQ ID NO: 658 - protein, 160 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVY

SEQ ID NO: 659 - protein, 161 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYF

SEQ ID NO: 660 - protein, 162 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFN

SEQ ID NO: 661 - protein, 163 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNC

SEQ ID NO: 662 - protein, 164 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQ

SEQ ID NO: 663 - protein, 165 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQR

SEQ ID NO: 664 - protein, 166 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRE

SEQ ID NO: 665 - protein, 167 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQREN

SEQ ID NO: 666 - protein, 168 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENG

SEQ ID NO: 667 - protein, 169 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGS

SEQ ID NO: 668 - protein, 16 aa, Cucurbita maxima
MPRNRDPLVVGRVIGD

SEQ ID NO: 669 - protein, 170 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSG

SEQ ID NO: 670 - protein, 171 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGG

SEQ ID NO: 671 - protein, 17 aa, Cucurbita maxima
MPRNRDPLVVGRVIGDV

SEQ ID NO: 672 - protein, 18 aa, Cucurbita maxima
MPRNRDPLVVGRVIGDVV

SEQ ID NO: 673 - protein, 19 aa, Cucurbita maxima
MPRNRDPLVVGRVIGDVVD

SEQ ID NO: 674 - protein, 20 aa, Cucurbita maxima
MPRNRDPLVVGRVIGDVVDS

SEQ ID NO: 675 - protein, 21 aa, Cucurbita maxima
MPRNRDPLVVGRVIGDVVDSF

SEQ ID NO: 676 - protein, 22 aa, Cucurbita maxima
MPRNRDPLVVGRVIGDVVDSFS

SEQ ID NO: 677 - protein, 23 aa, Cucurbita maxima
MPRNRDPLVVGRVIGDVVDSFSR

SEQ ID NO: 678 - protein, 24 aa, Cucurbita maxima
MPRNRDPLVVGRVIGDVVDSFSRS

SEQ ID NO: 679 - protein, 3 aa, Cucurbita maxima
MPR

SEQ ID NO: 680 - protein, 4 aa, Cucurbita maxima
MPRN

SEQ ID NO: 681 - protein, 5 aa, Cucurbita maxima
MPRNR

SEQ ID NO: 682 - protein, 6 aa, Cucurbita maxima
MPRNRD

SEQ ID NO: 683 - protein, 7 aa, Cucurbita maxima
MPRNRDP

SEQ ID NO: 684 - protein, 86 aa, Cucurbita maxima
MPRNRDPLVVGRVIGDVVDSFSRSISIRVVYDSREVNNGCELKPSQAVNKPRVEIGGTDLRTFFTLVMVDPDAPSPSDPNLREYLH

SEQ ID NO: 685 - protein, 8 aa, Cucurbita maxima
MPRNRDPL

SEQ ID NO: 686 - protein, 9 aa, Cucurbita maxima
MPRNRDPLV

SEQ ID NO: 687 - protein, 170 aa, Cucurbita maxima
GRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 688 - protein, 169 aa, Cucurbita maxima
RVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 689 - protein, 168 aa, Cucurbita maxima
VIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 690 - protein, 167 aa, Cucurbita maxima
IGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 691 - protein, 166 aa, Cucurbita maxima
GDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 692 - protein, 165 aa, Cucurbita maxima
DVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 693 - protein, 164 aa, Cucurbita maxima
VVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 694 - protein, 163 aa, Cucurbita maxima
VDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 695 - protein, 162 aa, Cucurbita maxima
DSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 696 - protein, 161 aa, Cucurbita maxima
SFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 697 - protein, 179 aa, Cucurbita maxima
PRNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 698 - protein, 160 aa, Cucurbita maxima
FSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 699 - protein, 159 aa, Cucurbita maxima
SRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 700 - protein, 158 aa, Cucurbita maxima
RSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 701 - protein, 157 aa, Cucurbita maxima
SISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 702 - protein, 156 aa, Cucurbita maxima
ISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 703 - protein, 155 aa, Cucurbita maxima
SIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 704 - protein, 154 aa, Cucurbita maxima
IRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 705 - protein, 178 aa, Cucurbita maxima
RNRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 706 - protein, 145 aa, Cucurbita maxima
VNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 707 - protein, 177 aa, Cucurbita maxima
NRDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 708 - protein, 134 aa, Cucurbita maxima
AVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 709 - protein, 176 aa, Cucurbita maxima
RDPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 710 - protein, 175 aa, Cucurbita maxima
DPLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 711 - protein, 113 aa, Cucurbita maxima
MVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 712 - protein, 174 aa, Cucurbita maxima
PLVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 713 - protein, 173 aa, Cucurbita maxima
LVVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 714 - protein, 172 aa, Cucurbita maxima
VVGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 715 - protein, 84 aa, Cucurbita maxima
EATFGQEIVCYENPRPTVGIHRFVLVLFRQLGRQTVYAPGWRQNFNTRHFAELYNLGSPVAAVYFNCQRENGSGGRRRAGDECS

SEQ ID NO: 716 - protein, 171 aa, Cucurbita maxima
VGRVIGDVVDSFSRSISIRVVYDSREVNNGCELKPSQAVNKPRVEIGGTDLRTFFTLVMVDPDAPSPSDPNLREYLHWLVTDIPATTEATFGQEIVCYENPRPTVGIHRFVLVLFRQLGRQTVYAPGWRQNFNTRHFAELYNLGSPVAAVYFNCQRENGSGGRRRAGDECS

SEQ ID NO: 717 - DNA, 534 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 718 - DNA, 309 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcag

SEQ ID NO: 719 - DNA, 30 bp, Festuca arundinacea
atggctgggagggatagggacccgttggtg

SEQ ID NO: 720 - DNA, 33 bp, Festuca arundinacea
atggctgggagggatagggacccgttggtggtt

SEQ ID NO: 721 - DNA, 36 bp, Festuca arundinacea
atggctgggagggatagggacccgttggtggttgga

SEQ ID NO: 722 - DNA, 411 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccggg

SEQ ID NO: 723 - DNA, 39 bp, Festuca arundinacea
atggctgggagggatagggacccgttggtggttggaagg

SEQ ID NO: 724 - DNA, 42 bp, Festuca arundinacea
atggctgggagggatagggacccgttggtggttggaagggtt

SEQ ID NO: 725 - DNA, 453 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctac

SEQ ID NO: 726 - DNA, 456 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaac

SEQ ID NO: 727 - DNA, 459 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctc

SEQ ID NO: 728 - DNA, 462 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggc

SEQ ID NO: 729 - DNA, 465 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccg

SEQ ID NO: 730 - DNA, 468 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggcc

SEQ ID NO: 731 - DNA, 471 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtc

SEQ ID NO: 732 - DNA, 474 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgcc

SEQ ID NO: 733 - DNA, 477 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgcc

SEQ ID NO: 734 - DNA, 45 bp, Festuca arundinacea
atggctgggagggatagggacccgttggtggttggaagggttgtg

SEQ ID NO: 735 - DNA, 480 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtc

SEQ ID NO: 736 - DNA, 483 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctac

SEQ ID NO: 737 - DNA, 486 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttc

SEQ ID NO: 738 - DNA, 489 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaac

SEQ ID NO: 739 - DNA, 492 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgc

SEQ ID NO: 740 - DNA, 495 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccag

SEQ ID NO: 741 - DNA, 498 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgc

SEQ ID NO: 742 - DNA, 501 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgag

SEQ ID NO: 743 - DNA, 504 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggcc

SEQ ID NO: 744 - DNA, 507 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggc

SEQ ID NO: 745 - DNA, 48 bp, Festuca arundinacea
atggctgggagggatagggacccgttggtggttggaagggttgtgggg

SEQ ID NO: 746 - DNA, 510 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctct

SEQ ID NO: 747 - DNA, 513 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggc

SEQ ID NO: 748 - DNA, 516 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggc

SEQ ID NO: 749 - DNA, 51 bp, Festuca arundinacea
atggctgggagggatagggacccgttggtggttggaagggttgtgggggac

SEQ ID NO: 750 - DNA, 54 bp, Festuca arundinacea
atggctgggagggatagggacccgttggtggttggaagggttgtgggggacgtg

SEQ ID NO: 751 - DNA, 57 bp, Festuca arundinacea
atggctgggagggatagggacccgttggtggttggaagggttgtgggggacgtgctg

SEQ ID NO: 752 - DNA, 60 bp, Festuca arundinacea
atggctgggagggatagggacccgttggtggttggaagggttgtgggggacgtgctggac

SEQ ID NO: 753 - DNA, 63 bp, Festuca arundinacea
atggctgggagggatagggacccgttggtggttggaagggttgtgggggacgtgctggacccc

SEQ ID NO: 754 - DNA, 66 bp, Festuca arundinacea
atggctgggagggatagggacccgttggtggttggaagggttgtgggggacgtgctggaccccttc

SEQ ID NO: 755 - DNA, 69 bp, Festuca arundinacea
atggctgggagggatagggacccgttggtggttggaagggttgtgggggacgtgctggaccccttcgtc

SEQ ID NO: 756 - DNA, 72 bp, Festuca arundinacea
atggctgggagggatagggacccgttggtggttggaagggttgtgggggacgtgctggaccccttcgtccgc

SEQ ID NO: 757 - DNA, 75 bp, Festuca arundinacea
atggctgggagggatagggacccgttggtggttggaagggttgtgggggacgtgctggaccccttcgtccgcacc

SEQ ID NO: 758 - DNA, 12 bp, Festuca arundinacea
atggctgggagg

SEQ ID NO: 759 - DNA, 15 bp, Festuca arundinacea
atggctgggagggat

SEQ ID NO: 760 - DNA, 18 bp, Festuca arundinacea
atggctgggagggatagg

SEQ ID NO: 761 - DNA, 21 bp, Festuca arundinacea
atggctgggagggatagggac

SEQ ID NO: 762 - DNA, 261 bp, Festuca arundinacea
atggctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccat

SEQ ID NO: 763 - DNA, 24 bp, Festuca arundinacea
atggctgggagggatagggacccg

SEQ ID NO: 764 - DNA, 27 bp, Festuca arundinacea
atggctgggagggatagggacccgttg

SEQ ID NO: 765 - DNA, 504 bp, Festuca arundinacea
gttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 766 - DNA, 501 bp, Festuca arundinacea
ggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 767 - DNA, 498 bp, Festuca arundinacea
agggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 768 - DNA, 495 bp, Festuca arundinacea
gttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 769 - DNA, 492 bp, Festuca arundinacea
gtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 770 - DNA, 489 bp, Festuca arundinacea
ggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 771 - DNA, 486 bp, Festuca arundinacea
gacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 772 - DNA, 483 bp, Festuca arundinacea
gtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 773 - DNA, 480 bp, Festuca arundinacea
ctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 774 - DNA, 477 bp, Festuca arundinacea
gaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 775 - DNA, 531 bp, Festuca arundinacea
gctgggagggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 776 - DNA, 474 bp, Festuca arundinacea
cccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 777 - DNA, 471 bp, Festuca arundinacea
ttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 778 - DNA, 468 bp, Festuca arundinacea
gtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 779 - DNA, 465 bp, Festuca arundinacea
cgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 780 - DNA, 462 bp, Festuca arundinacea
accactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 781 - DNA, 459 bp, Festuca arundinacea
actaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 782 - DNA, 456 bp, Festuca arundinacea
aacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 783 - DNA, 453 bp, Festuca arundinacea
ctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 784 - DNA, 426 bp, Festuca arundinacea
gtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 785 - DNA, 525 bp, Festuca arundinacea
agggatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 786 - DNA, 393 bp, Festuca arundinacea
gtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 787 - DNA, 522 bp, Festuca arundinacea
gatagggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 788 - DNA, 519 bp, Festuca arundinacea
agggacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 789 - DNA, 330 bp, Festuca arundinacea
atggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 790 - DNA, 516 bp, Festuca arundinacea
gacccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 791 - DNA, 513 bp, Festuca arundinacea
ccgttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 792 - DNA, 510 bp, Festuca arundinacea
ttggtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 793 - DNA, 243 bp, Festuca arundinacea
ggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 794 - DNA, 507 bp, Festuca arundinacea
gtggttggaagggttgtgggggacgtgctggaccccttcgtccgcaccactaacctcagggtgacattcggaaaccgggccgtgtccaacggctgcgagctcaagccctccatggtcacccaccagcccagggtcgaggtcggcggcaatgagatgaggaccttctacacactcgtgatggtagaccccgacgcgccaagtccaagcgatcccaacctcagagaatacctccattggttggtgacagatattcctggaactactggtgcttccttcgggcaggaggtgatgtgctacgagagccctcgccccaacatgggaatccaccgcttcgtgctcgtactcttccagcagctgggccggcagacggtgtacgcgcccgggtggcgccagaacttcaataccagggacttcgccgagctctacaacctcggcccggccgtcgccgccgtctacttcaactgccagcgcgaggccggctctggcggcaggaggatgtataattga

SEQ ID NO: 795 - protein, 177 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 796 - protein, 103 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQ

SEQ ID NO: 797 - protein, 10 aa, Festuca arundinacea
MAGRDRDPLV

SEQ ID NO: 798 - protein, 11 aa, Festuca arundinacea
MAGRDRDPLVV

SEQ ID NO: 799 - protein, 12 aa, Festuca arundinacea
MAGRDRDPLVVG

SEQ ID NO: 800 - protein, 137 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPG

SEQ ID NO: 801 - protein, 13 aa, Festuca arundinacea
MAGRDRDPLVVGR

SEQ ID NO: 802 - protein, 14 aa, Festuca arundinacea
MAGRDRDPLVVGRV

SEQ ID NO: 803 - protein, 151 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELY

SEQ ID NO: 804 - protein, 152 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYN

SEQ ID NO: 805 - protein, 153 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNL

SEQ ID NO: 806 - protein, 154 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLG

SEQ ID NO: 807 - protein, 155 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGP

SEQ ID NO: 808 - protein, 156 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPA

SEQ ID NO: 809 - protein, 157 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAV

SEQ ID NO: 810 - protein, 158 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVA

SEQ ID NO: 811 - protein, 159 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAA

SEQ ID NO: 812 - protein, 15 aa, Festuca arundinacea
MAGRDRDPLVVGRVV

SEQ ID NO: 813 - protein, 160 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAV

SEQ ID NO: 814 - protein, 161 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVY

SEQ ID NO: 815 - protein, 162 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYF

SEQ ID NO: 816 - protein, 163 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFN

SEQ ID NO: 817 - protein, 164 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNC

SEQ ID NO: 818 - protein, 165 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQ

SEQ ID NO: 819 - protein, 166 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQR

SEQ ID NO: 820 - protein, 167 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQRE

SEQ ID NO: 821 - protein, 168 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREA

SEQ ID NO: 822 - protein, 169 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAG

SEQ ID NO: 823 - protein, 16 aa, Festuca arundinacea
MAGRDRDPLVVGRVVG

SEQ ID NO: 824 - protein, 170 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGS

SEQ ID NO: 825 - protein, 171 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSG

SEQ ID NO: 826 - protein, 172 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGG

SEQ ID NO: 827 - protein, 17 aa, Festuca arundinacea
MAGRDRDPLVVGRVVGD

SEQ ID NO: 828 - protein, 18 aa, Festuca arundinacea
MAGRDRDPLVVGRVVGDV

SEQ ID NO: 829 - protein, 19 aa, Festuca arundinacea
MAGRDRDPLVVGRVVGDVL

SEQ ID NO: 830 - protein, 20 aa, Festuca arundinacea
MAGRDRDPLVVGRVVGDVLD

SEQ ID NO: 831 - protein, 21 aa, Festuca arundinacea
MAGRDRDPLVVGRVVGDVLDP

SEQ ID NO: 832 - protein, 22 aa, Festuca arundinacea
MAGRDRDPLVVGRVVGDVLDPF

SEQ ID NO: 833 - protein, 23 aa, Festuca arundinacea
MAGRDRDPLVVGRVVGDVLDPFV

SEQ ID NO: 834 - protein, 24 aa, Festuca arundinacea
MAGRDRDPLVVGRVVGDVLDPFVR

SEQ ID NO: 835 - protein, 25 aa, Festuca arundinacea
MAGRDRDPLVVGRVVGDVLDPFVRT

SEQ ID NO: 836 - protein, 4 aa, Festuca arundinacea
MAGR

SEQ ID NO: 837 - protein, 5 aa, Festuca arundinacea
MAGRD

SEQ ID NO: 838 - protein, 6 aa, Festuca arundinacea
MAGRDR

SEQ ID NO: 839 - protein, 7 aa, Festuca arundinacea
MAGRDRD

SEQ ID NO: 840 - protein, 87 aa, Festuca arundinacea
MAGRDRDPLVVGRVVGDVLDPFVRTTNLRVTFGNRAVSNGCELKPSMVTHQPRVEVGGNEMRTFYTLVMVDPDAPSPSDPNLREYLH

SEQ ID NO: 841 - protein, 8 aa, Festuca arundinacea
MAGRDRDP

SEQ ID NO: 842 - protein, 9 aa, Festuca arundinacea
MAGRDRDPL

SEQ ID NO: 843 - protein, 167 aa, Festuca arundinacea
VGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 844 - protein, 166 aa, Festuca arundinacea
GRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 845 - protein, 165 aa, Festuca arundinacea
RVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 846 - protein, 164 aa, Festuca arundinacea
VVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 847 - protein, 163 aa, Festuca arundinacea
VGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 848 - protein, 162 aa, Festuca arundinacea
GDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 849 - protein, 161 aa, Festuca arundinacea
DVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 850 - protein, 160 aa, Festuca arundinacea
VLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 851 - protein, 159 aa, Festuca arundinacea
LDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 852 - protein, 158 aa, Festuca arundinacea
DPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 853 - protein, 174 aa, Festuca arundinacea
AGRDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRM

SEQ ID NO: 854 - protein, 157 aa, Festuca arundinacea
PFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 855 - protein, 156 aa, Festuca arundinacea
FVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 856 - protein, 155 aa, Festuca arundinacea
VRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 857 - protein, 154 aa, Festuca arundinacea
RTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 858 - protein, 153 aa, Festuca arundinacea
TTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 859 - protein, 152 aa, Festuca arundinacea
TNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 860 - protein, 151 aa, Festuca arundinacea
NLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 861 - protein, 150 aa, Festuca arundinacea
LRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 862 - protein, 141 aa, Festuca arundinacea
VSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 863 - protein, 174 aa, Festuca arundinacea
RDRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 864 - protein, 130 aa, Festuca arundinacea
VTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 865 - protein, 173 aa, Festuca arundinacea
DRDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 866 - protein, 172 aa, Festuca arundinacea
RDPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 867 - protein, 109 aa, Festuca arundinacea
MVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 868 - protein, 171 aa, Festuca arundinacea
DPLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 869 - protein, 170 aa, Festuca arundinacea
PLVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 870 - protein, 169 aa, Festuca arundinacea
LVVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

SEQ ID NO: 871 - protein, 80 aa, Festuca arundinacea
GASFGQEVMCYESPRPNMGIHRFVLVLFQQLGRQTVYAPGWRQNFNTRDFAELYNLGPAVAAVYFNCQREAGSGGRRMYN

SEQ ID NO: 872 - protein, 168 aa, Festuca arundinacea
VVGRVVGDVLDPFVRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPAVAAVYFNCQREAGSGGRRMYN

We claim:

1. An isolated polynucleotide comprising SEQ ID NO: 132.

2. The polynucleotide of claim 1, wherein the polynucleotide encodes a polypeptide that regulates long distance florigenic signaling.

3. An isolated polynucleotide that encodes the amino acid sequence of SEQ ID NO: 165.

4. A genetic construct comprising an isolated polynucleotide according to any one of claims 1 and 3.

5. A transgenic cell comprising the genetic construct of claim 4, wherein the transgenic cell is a bacterial cell or a plant cell.

6. A transgenic plant comprising a transgenic cell of claim 5.

7. A method for modulating the activity of a polypeptide in a target plant, comprising stably incorporating into the genome of the plant a genetic construct of claim 4, wherein the polypeptide comprises SEQ ID NQ: 165.

8. A method for inducing flowering in a plant grown under non-inductive conditions, comprising introducing into the plant a recombinant genetic construct comprising a polynucleotide of any one of claims 1 and 3, and expressing the polynucleotide in the vasculature of the plant.

* * * * *